(12) United States Patent
Scheel et al.

(10) Patent No.: US 9,388,389 B2
(45) Date of Patent: Jul. 12, 2016

(54) JFH-1 BASED HCV CELL CULTURE SYSTEMS FOR NS5A OF GENOTYPES 1-7

(75) Inventors: Troels Kasper Høyer Scheel, Copenhagen NV (DK); Judith M. Gottwein, Frederiksberg C (DK); Tanja Bertelsen Jensen, Frederiksberg C (DK); Jens Bukh, Praestø (DK)

(73) Assignees: Hvidovre Hospital, Hvidovre (DK); Kobenhavns Universitet, Copenhagen K (DK)

(*) Notice: Subject to any disclaimer, the term of this patent is extended or adjusted under 35 U.S.C. 154(b) by 339 days.

(21) Appl. No.: 13/499,788

(22) PCT Filed: Oct. 1, 2010

(86) PCT No.: PCT/IB2010/002620
§ 371 (c)(1),
(2), (4) Date: Nov. 8, 2012

(87) PCT Pub. No.: WO2011/039639
PCT Pub. Date: Apr. 7, 2011

(65) Prior Publication Data
US 2013/0052716 A1 Feb. 28, 2013

(30) Foreign Application Priority Data
Oct. 2, 2009 (DK) .................. 2009 70142

(51) Int. Cl.
C12N 7/00 (2006.01)
C07K 14/005 (2006.01)
C12Q 1/18 (2006.01)
G01N 33/569 (2006.01)
A61K 39/00 (2006.01)

(52) U.S. Cl.
CPC .............. *C12N 7/00* (2013.01); *C07K 14/005* (2013.01); *C12Q 1/18* (2013.01); *G01N 33/56983* (2013.01); *A61K 39/00* (2013.01); *C12N 2770/24222* (2013.01); *C12N 2770/24251* (2013.01); *G01N 2333/18* (2013.01)

(58) Field of Classification Search
None
See application file for complete search history.

(56) References Cited

U.S. PATENT DOCUMENTS

| | | |
|---|---|---|
| 7,084,266 B1 | 8/2006 | Yanagi |
| 7,674,612 B2 | 3/2010 | Rice et al. |
| 8,454,974 B2 | 6/2013 | Scheel et al. |
| 8,506,969 B2 | 8/2013 | Gottwein et al. |
| 2010/0093841 A1 | 4/2010 | Gottwein et al. |
| 2011/0021611 A1 | 1/2011 | Jensen et al. |
| 2011/0059512 A1 | 3/2011 | Gottwein et al. |
| 2011/0059513 A1 | 3/2011 | Scheel et al. |
| 2011/0294194 A1 | 12/2011 | Gottwein et al. |
| 2012/0003719 A1 | 1/2012 | Prento et al. |
| 2012/0003741 A1 | 1/2012 | Gottwein et al. |
| 2012/0189648 A1 | 7/2012 | Gottwein et al. |

FOREIGN PATENT DOCUMENTS

| | | |
|---|---|---|
| EP | 1627917 A1 | 2/2006 |
| WO | 00/75338 A2 | 12/2000 |
| WO | 2013139340 A1 | 9/2013 |

OTHER PUBLICATIONS

Tsai et al. The non-structural 5A protein of hepatitis C virus exhibits genotypic differences in interferon antagonism. J Hepatol. Dec. 2008;49(6):899-907. Epub Sep. 16, 2008.*
Kato et al. Efficient replication of the genotype 2a hepatitis C virus subgenomic replicon. Gastroenterology. Dec. 2003;125(6):1808-17.*
Pietschmann et al. Construction and characterization of infectious intragenotypic and intergenotypic hepatitis C virus chimeras. Proc Natl Acad Sci U S A. May 9, 2006;103(19):7408-13. Epub May 1, 2006.*
Murray et al. Alanine Scanning of the Hepatitis C Virus Core Protein Reveals Numerous Residues Essential for Production of Infectious Virus. J Virol. Oct. 2007; 81(19): 10220-10231. Published online Jul. 18, 2007.*
Yi et al. Compensatory mutations in E1, p7, NS2, and NS3 enhance yields of cell culture-infectious intergenotypic chimeric hepatitis C virus. J Virol. Jan. 2007;81(2):629-38. Epub Nov. 1, 2006.*
GenBank: EU363761.1. Recombinant Hepatitis C virus H77C/JFH1, complete genome. Dec. 5, 2008.*
GenBank: AF011751.1. Hepatitis C virus strain H77 pCV-H77C polyprotein gene, complete cds. Aug. 20, 1997.*
Gottwein et al., "Development and Characterization of Hepatitis C Virus Genotype 1-7 Cell Culture Systems: Role of CD81 and Scavenger Receptor Class B Type I and Effect of Antiviral Drugs", Hepatology, Oct. 9, 2008, pp. 364-377, vol. 49, No. 2, Williams and Wilkins, Baltimore, MD.
Lindenbach et al., "Complete Replication of Hepatitis C Virus in Cell Culture", Science, Jul. 22, 2005, American Association for the Advancement of Science, pp. 623-626, vol. 309, No. 5734, Washington, DC.

(Continued)

*Primary Examiner* — Nick Zou
(74) *Attorney, Agent, or Firm* — Thompson Coburn LLP; Charles P. Romano

(57) ABSTRACT

The present inventors developed hepatitis C virus recombinants expressing NS5A from genotype 1a, 1b, 2a, 3a, 4a, 5a, 6a or 7a in the context of a genotype 2a backbone. Additional recombinants express NS5A and the structural proteins (Core, E1 and E2), p7 and NS2 from genotype 1a, 1b, 3a, 4a, 5a, 6a or 7a in the genotype 2a backbone. Sequence analysis of the recombinants recovered after viral passage in Huh7.5 cells revealed adaptive mutations in NS5A and/or NS3. The importance of these mutations for improved growth kinetics was shown in reverse genetic studies.

18 Claims, 22 Drawing Sheets

(56) References Cited

OTHER PUBLICATIONS

Figure 1:
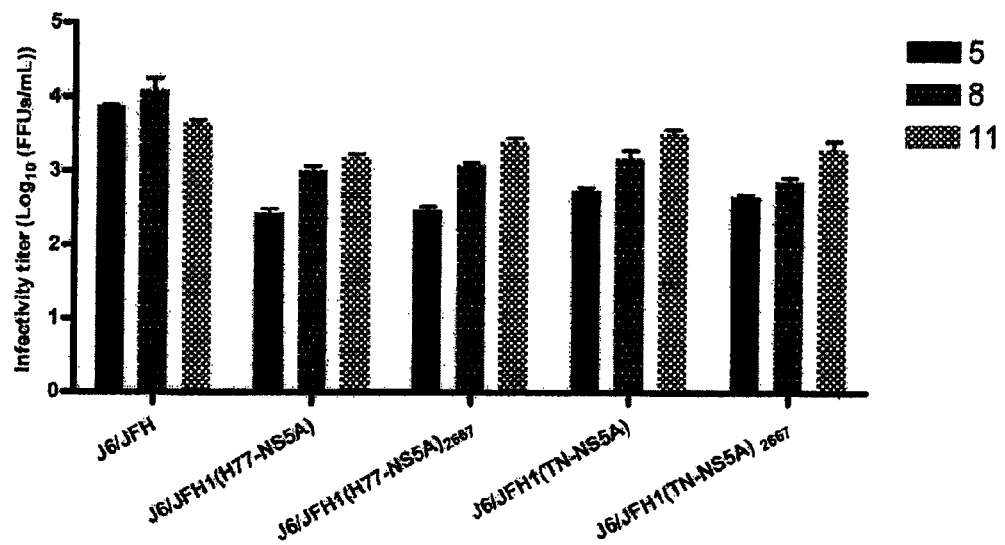
Figure 2A:
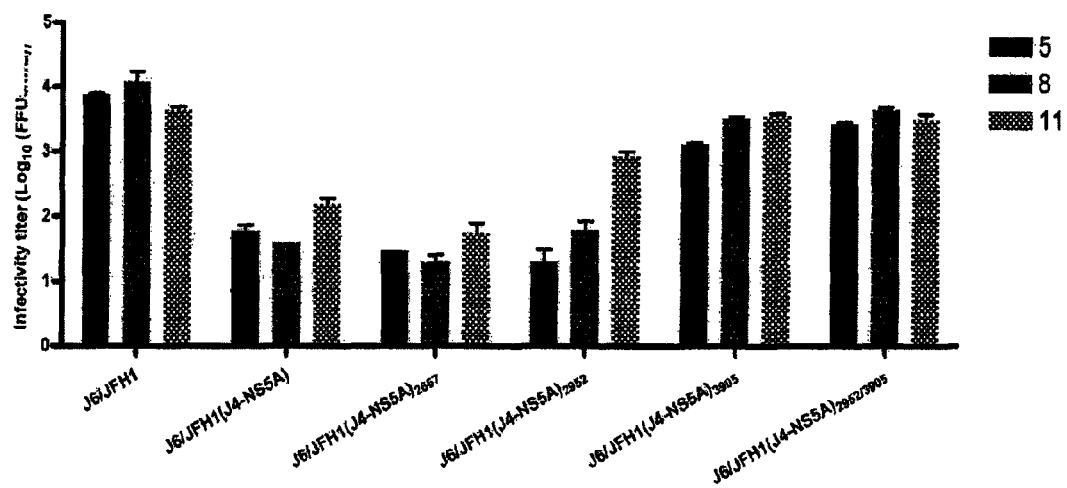
Figure 2B:
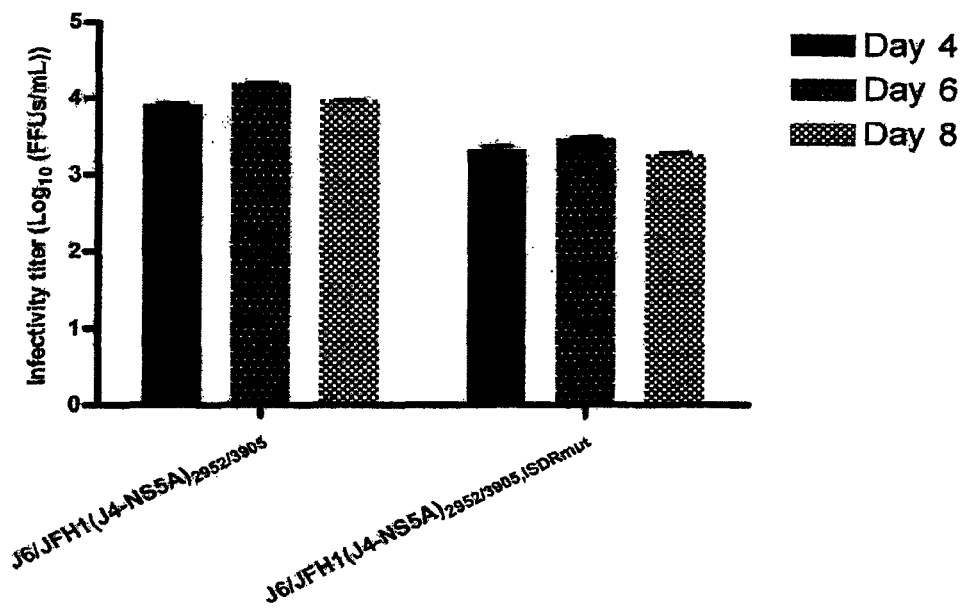
Figure 3:
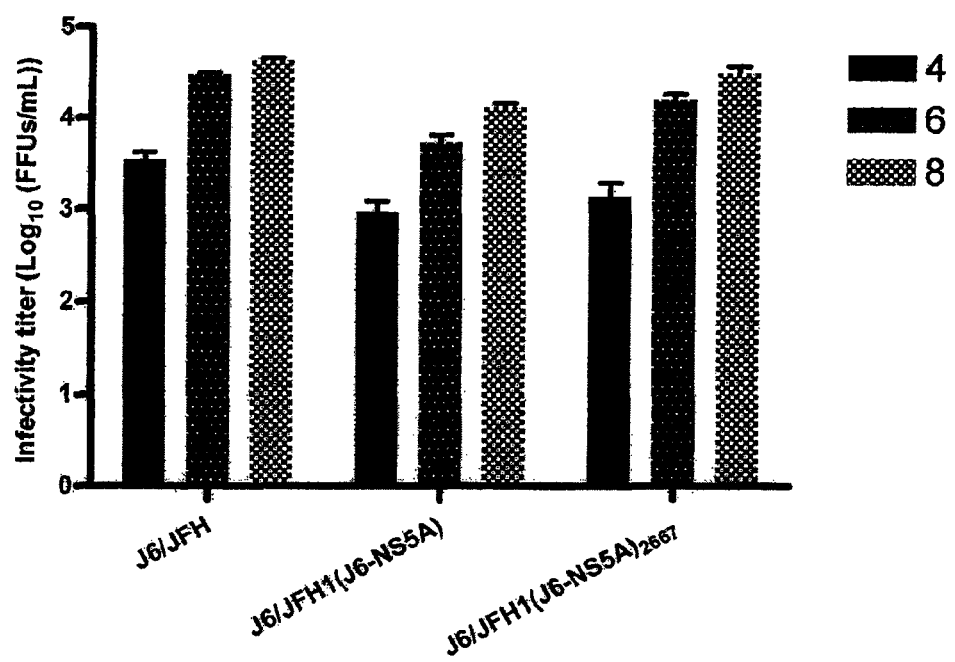

Lanford et al., "Hepatitis C Virus Genotype 1b Chimeric Replicon Containing Genotype 3a NS5A Domain", Virology, Nov. 25, 2006, pp. 192-202, vol. 355, No. 2, Academic Press, Orlando, US.

Tsai et al., "The Non-Structural 5A Protein of Hepatitis C Virus Exhibits Genotypic Differences in Interferon Antagonism", Journal of Hepatology, Dec. 1, 2008, pp. 899-907, vol. 49, No. 6, Munksgaard International Publishers, Copenhagen, DK.

Szabo et al., "Hepatitis C Virus NS5A Protein-A Master Regulator?", Gastroenterology, Mar. 1, 2006, pp. 995-999, vol. 130, No. 3, Elsevier, Philadelphia, PA.

Gottwein et al., "Cutting the Gordian Knot-Development and Biological Relevance of Hepatitis C Virus Cell Culture Systems", Advances in Virus Research, Jan. 2008, pp. 51-113, vol. 71, Academic Press.

Scheel et al., "Recombinant HCV Variants With NS5A From Genotypes 1-7 Have Different Sensitivities to an NS5A Inhibitor But Not Interferon-alpha", Gastroenterology, Nov. 25, 2010, pp. 1032-1042, vol. 140, No. 3, Retrieved from the Internet on Feb. 17, 2011.

Bukh et al., "Mutations that Permit Efficient Replication of Hepatitis C Virus RNA in Huh-7 Cells Prevent Productive Replication in Chimpanzees", Proceedings of the National Academy of Sciences of the United States of America (PNAS), Oct. 29, 2002, pp. 14416-14421, vol. 99, No. 22.

Scheel et al., "Analysis of Functional Differences Between Hepatitis C Virus NS5A of Genotypes 1-7 in Infectious Cell Culture Systems", Plos Pathogens, May 2012, pp. 1-16, vol. 8, Issue 5.

\* cited by examiner

JFH-1 BASED HCV CELL CULTURE SYSTEMS FOR NS5A OF GENOTYPES 1-7

CROSS-REFERENCE TO RELATED APPLICATIONS

This application is a National Stage application of International Patent Application No PCT/IB2010/002620, filed Oct. 1, 2010, which is incorporated herein by reference in its entirety and which claims the benefit of Danish Patent Application number PA 200970142, filed Oct. 2, 2009, which is incorporated herein by reference in its entirety.

INCORPORATION OF SEQUENCE LISTING

A computer readable form of the sequence listing is provided herein, containing the file named "66146_103517_SEQ_LIST.txt", which is 3,348,332 bytes in size (measured in MS-Windows), and is herein incorporated by reference in its entirety. This Sequence Listing consists of SEQ ID NOs: 1-200.

TECHNICAL FIELD OF THE INVENTION

The present invention provides infectious recombinant hepatitis C virus expressing the NS5A gene from 7 major genotypes in a genotype 2a backbone. Recombinant hepatitis C virus expressing genotype-specific NS5A and the structural proteins (Core, E1 and E2), p7 and NS2 from genotype 1a, 1b, 3a, 4a, 5a, 6a, and 7a are also provided by the present invention.

The present invention further provides methods of producing the infectious HCV recombinants expressing the NS5A gene, and their use in identifying anti-HCV therapeutics including use in vaccines and diagnosis, as well as sequences of HCV associated with HCV pathogenesis.

BACKGROUND OF THE INVENTION

Hepatitis C is one of the most widespread infectious diseases in the world. About 180 million people are infected with hepatitis C virus (HCV) worldwide with a yearly incidence of 3-4 million. While the acute phase of infection is mostly asymptomatic, the majority of acutely infected individuals develops chronic hepatitis and is at increased risk of developing liver cirrhosis and hepatocellular carcinoma. Thus, HCV infection is a major contributor to end-stage liver disease, and in developed countries to liver transplantation.

HCV is a small, enveloped virus classified as a member of the Flaviviridae family. Its genome consists of a 9.6 kb single stranded RNA of positive polarity composed of 5' and 3 untranslated regions (UTR) and one long open reading frame (ORF) encoding a polyprotein, which is co- and post-translationally cleaved and thus yields the structural (Core, E1, E2), p7 and nonstructural (NS2, NS3, NS4A, NS4B, NS5A, NS5B) proteins (Gottwein et al. 2008).

HCV isolates from around the world exhibit significant genetic heterogeneity. At least 7 major HCV genotypes (genotypes 1-7) have been identified, which differ by 31-33% at the nucleotide level and deduced amino acid level. In addition, there are numerous subtypes (a, b, c, etc.), which differ by 20-25% on the nucleotide and deduced amino acid level (Gottwein et al. 2008).

While HCV genotypes 1-3 predominate in the Western World, genotypes 4-6 are more common in areas with high prevalence or even endemic levels of HCV infection. Genotype 6 is highly prevalent in Southeast Asia. Recently, a genotype 7a was discovered in Canadian and Belgian patients, who presumably were infected in Central Africa (Murphy et al., 2007).

While the only approved treatment for chronic HCV infection, combination therapy with interferon-α and ribavirin, leads to a sustained virologic response in most of genotype 2 or 3 patients, viral clearance is only obtained for about half of patients with genotype 1 or 4. There is no vaccine against HCV.

Since its discovery in 1989, research on HCV has been hampered by the lack of appropriate cell culture systems allowing for research on the complete viral life cycle as well as new therapeutics and vaccines.

In 2001, a genotype 2a isolate (JFH1) was described (Kato et al., 2001), which yielded high RNA titers in the replicon system without adaptive mutations (Kato et al., 2003).

A major breakthrough occurred in 2005, when formation of infectious viral particles was reported after transfection of RNA transcripts from the JFH1 full-length consensus cDNA clone into Huh7 cells (Wakita et al., 2005).

At the same time, Lindenbach et al. demonstrated that the intragenotypic 2a/2a recombinant genome (J6/JFH1), in which the structural genes (Core, E1, E2), p7 and NS2 of JFH1 were replaced by the respective genes of clone J6CF, produced infectious viral particles in Huh7.5 cells (a cell line derived from bulk Huh7 cells) with an accelerated kinetic (Lindenbach et al., 2005). Cell culture derived J6/JFH viruses were apparently fully viable in vivo.

Despite the importance of the described cell culture systems they represent only a single subtype (genotype 2a) of HCV. It is important to develop cell culture systems for representative strains of other HCV genotypes, since neutralizing antibodies are not expected to cross-neutralize all genotypes and new specific antiviral compounds might have differential efficiencies against different genotypes.

Thus, the present inventors recently developed JFH1-based intergenotypic recombinants with the structural genes (Core, E1 and E2), p7 and NS2 of all seven major genotypes, depending on the JFH1 genes NS3, NS4A, NS4B, NS5A and NS5B and the JFH1 untranslated regions for efficient replication. These systems allow for genotype-specific functional studies of HCV entry, assembly/release and of the NS2 protease. In addition, these systems can be used for studies of neutralizing antibodies, receptor usage etc. Thus the present inventors previously developed JFH-1 based intergenotypic recombinant viruses of all seven major genotypes.

The HCV NS5A protein plays a vital but undefined role in viral RNA replication. It is a large (56 to 58 kDa) hydrophilic phosphoprotein, divided into three putative principal domains (I-III). The domains are separated by repetitive low-complexity sequences (LCSI and II). The crystal structure of the well-conserved domain I was determined. N-terminal of domain I is located an amphipathic alpha-helix that anchors the protein to membrane structures. Disruption of the amphipathic alpha-helix attenuates replication in the replicon system. Four essential cysteine residues within domain I collectively bind to a single structural zinc ion, and in the replicon system mutation of these residues results in attenuation of RNA replication. The zinc-binding domain exhibit conserved external surfaces, which presumably interact with viral and cellular proteins. Domain I also contains a highly basic channel, which could serve as an RNA-binding pocket during replication. NS5A domains II and III are far less conserved among HCV genotypes than domain I, and its functions are less well understood. Large parts of domain II and III were shown to be disposable for replication in replicon systems. Instead it was suggested that domain III plays an important role during particle formation. Replication efficiency was shown to be influenced by NS5A phosphorylation state. The hyperphosphorylated form (58 kDa) induced by the action of cellular kinases seemed to reduce replication while the basely phosphorylated form (56 kDa) enhanced replication (Gottwein et al. 2008).

A number of studies suggested NS5A to contribute to differential response rates to interferon-alpha in patients infected with genotype 1 versus genotype 2 and 3. In addition, some studies suggested that the sequence of the putative interferon-sensitivity determining region (ISDR) in NS5A domain II has an influence on treatment outcome. Also, binding of NS5A to proteins such as PKR and 2',5'-oligoadenylate synthetase (2,5-OAS) involved in innate immunity was suggested to be of importance for viral viability (Gottwein et al. 2008).

SUMMARY OF THE INVENTION

The present inventors have developed robust cell culture systems for genomes containing NS5A of HCV genotype 1-7. This is a significant advantage compared to previous cell culture systems for HCV all relying on the NS3, NS4A, NS4B, NS5A and NS5B genes from the JFH1 isolate of genotype 2a. The developed HCV recombinants express NS5A from genotype 1a, 1b, 2a, 3a, 4a, 5a, 6a or 7a in the context of a genotype 2a backbone. Additional recombinants express NS5A and the structural proteins (Core, E1 and E2), p7 and NS2 from genotype 1a, 1b, 3a, 4a, 5a, 6a or 7a in the genotype 2a backbone.

In its broadest aspect the present invention relates to a replicating RNA comprising the structural genes (Core, E1 and E2), p7 and the non-structural gene NS2 from the human hepatitis C virus genotype 2a strain 36, the non-structural genes NS3, NS4A, NS4B and NS5B from the human hepatitis C virus genotype 2a strain JFH1 and the non-structural gene NS5A from the human hepatitis C virus genotype selected from the group consisting of 1a, 1b, 2a, 3a, 4a, 5a, 6a and 7a with the proviso that the NS5A gene from genotype 2a strain is not JFH1.

In another aspect the present invention pertains to an isolated nucleic acid molecule which encodes NS5A from genotype 1a, 1b, 2a, 3a, 4a, 5a, 6a and 7a or to an isolated nucleic acid molecule which encodes NS5A and the structural protein (Core, E1 and E2), p7 and NS2 from genotype 1a, 1b, 3a, 4a, 5a, 6a and 7a, wherein said molecule is capable of expressing said virus when transfected into cells.

In yet another aspect the present invention pertains to a composition comprising a nucleic acid molecule according to the present invention, a cassette vector for cloning viral genomes, methods for producing a cell which replicates HCV NS5A recombinant RNA and cells obtainable there from.

In another aspect the present invention pertains to methods for producing a hepatitis C virus particle, methods for in vitro producing a hepatitis C virus-infected cell.

In a further aspect the present invention pertains to methods for screening an anti-hepatitis C virus substance, hepatitis C vaccines comprising a hepatitis C virus particle, methods for producing a hepatitis C virus vaccine and antibodies against hepatitis C virus. In certain embodiments of the invention, nucleic acid sequences, cells comprising the same, viral particles comprising the same, and methods of making viral particles are provided. In certain embodiments, such nucleic acids comprise any of the aforementioned replicating RNAs or nucleic acids of the invention. In certain embodiments, an RNA comprising structural genes (Core, E1 and E2), p7 and non-structural gene NS2 from a human hepatitis C virus selected from the group consisting of genotypes 1a, 1b, 2a, 3a, 4a, 5a, 6a and 7a, non-structural genes NS3, NS4A, NS4B and NS5B from the human hepatitis C virus genotype 2a strain JFH1, and non-structural gene NS5A from the human hepatitis C virus genotype selected from the group consisting of 1a, 1b, 2a, 3a, 4a, 5a, 6a and 7a with the proviso that the NS5A gene from a genotype 2a strain is not JFH1, wherein the genotype of Core-NS2 correspond to that selected of the NS5A genotype and wherein the RNA is capable of infection in vivo and in vitro are provided. In certain embodiments, an RNA comprising the structural genes (Core, E1 and E2), p7 and the non-structural gene NS2 from the human hepatitis C virus genotype 2a strain 36, the non-structural genes NS3, NS4A, NS4B and NS5B from the human hepatitis C virus genotype 2a strain JFH1 and the non-structural gene NS5A from the human hepatitis C virus genotype selected from the group consisting of 1a, 1b, 2a, 3a, 4a, 5a, 6a and 7a with the proviso that the NS5A gene from genotype 2a strain is not JFH1 and wherein the RNA is capable of infection in vivo and in vitro are provided. In certain embodiments of any of the aforementioned nucleic acids, the genotype 1a is of the strain H77, DH6, HCV1, J1, or TN, the genotype 1b is of the strain 34, the genotype 2a is of the strain J6, the genotype 3a is of the strain S52, the genotype 4a is of the strain ED43, the genotype 5a is of the strain SA13, the genotype 6a is of the strain HK6a and the genotype 7a is of the strain QC69. In certain embodiments of the aforementioned nucleic acids or RNAs, the structural genes (Core, E1 and E2), p7 and non-structural gene NS2 from a human hepatitis C virus selected from the group consisting of genotypes 1a, 1b, 2a, 3a, 4a, 5a, 6a and 7a, said non-structural genes NS3, NS4A, NS4B, and NS5B from the human hepatitis C virus genotype 2a strain JFH1, and said non-structural gene NS5A from the human hepatitis C virus genotype are operably linked to an HCV 5' UTR and an HCV 3' UTR. In certain embodiments, the HCV 5' UTR and the HCV 3' UTR are from the human hepatitis C virus genotype 2a strain JFH1. In certain embodiments, of the aforementioned nucleic acids or RNAs, wherein said replicating RNA comprises an adaptive mutation.

Also provided are nucleic acid molecules or isolated nucleic acid molecules, which encodes human hepatitis C virus of a strain selected from the group consisting of: J6/JFH1 (DH6-NS5A), J6/JFH1 (HCV1-NS5A), and J6/JFH1 (J1-NS5A), wherein said molecule is capable of expressing said virus, when transfected into cells. In certain embodiments, the J6/JFH1 (DH6-NS5A), J6/JFH1 (HCV1-NS5A), or J6/JFH1 (J1-NS5A) nucleic acid can comprise one or more adaptive mutations in p7, NS2, NS3 and/or NS5A. In certain embodiments, J6/JFH1 (DH6-NS5A) encodes the amino acid sequence with a sequence identity of at least 90%, 95%, 98%, 99%, or 100% to that of SEQ ID NO: 198. In certain embodiments, J6/JFH1 (HCV1-NS5A) encodes the amino acid sequence with a sequence identity of at least 90%, 95%, 98%, 99%, or 100% to that of SEQ ID NO: 199. In certain embodiments, J6/JFH1 (J1-NS5A) encodes the amino acid sequence with a sequence identity of at least 90%, 95%, 98%, 99% or 100% to that of SEQ ID NO: 200. In certain embodiments, the J6/JFH1 (DH6-NS5A), J6/JFH1 (HCV1-NS5A), or J6/JFH1 (J1-NS5A) nucleic acid can comprise one or more mutations/modifications from the group consisting of the putative resistance mutation at amino acid position Y93H in NS5A (T93H for genotype 5a and 6a) encoded for by any possible nucleotide mutation as exemplified in SEQ ID NO 59-65 and deduced amino acid SEQ ID NO 140-146, ISDR 'sensitive-type' mutations of NS5A domain II as exemplified by SEQ ID NO 10 and the deduced amino acid SEQ ID NO 91, deletion mutants of NS5A domain II as exemplified for NS5A genotypes 1a and 2a in SEQ ID NO 66-68 and deduced amino acid SEQ ID NO 147-149, deletion mutants of NS5A domain III as exemplified by SEQ ID NO 69-78 and deduced amino acid SEQ ID NO 150-159, and viable NS5A epitope tag mutants as exemplified by SEQ ID NO 80-81 and deduced amino acid SEQ ID NO 161-162. Also provided are a method for method for producing a cell which replicates strain J6/JFH1 (DH6-NS5A), J6/JFH1 (HCV1-NS5A), or J6/JFH1 (J1-NS5A) comprising introducing a nucleic acid or RNA encoding said strain into a cell.

Also provided are cells comprising any of the aforementioned nucleic acids or RNAs of the invention. In certain embodiments, the cell is an Huh-7.5 cell.

Also provided are viral particles comprising any of the aforementioned RNAs of the invention.

Also provided are methods for producing a hepatitis C virus particle, comprising culturing the cell comprising any of the aforementioned nucleic acids or RNAs of the invention to allow the cell to produce the virus.

BRIEF DESCRIPTION OF THE DRAWINGS

FIGS. 1-12 and 16 show HCV infectivity titers after transfection of RNA transcripts of JFH1-based recombinants into Huh7.5 hepatoma cells. RNA transcripts of J6/JFH1 (controls) and JFH1-based NS5A recombinants with genotype-specific NS5A with and without putative adaptive mutations as indicated were transfected into Huh7.5 cells. Infectivity titers (focus-forming units (FFU)/mL) in supernatant were determined on days after transaction as indicated. n.d.: not done. n.i.: not infectious. Data points with no column shown in FIGS. 5 and 16 were not done.

FIG. 13 shows infectivity titers after viral passage to naïve Huh7.5 cells. Supernatants from transfection cultures >80% infected with recombinants as indicated were passaged to naïve cells. Infectivity titers (focus-forming units (FFU)/mL) in supernatant were determined on days after infection as indicated. n.d.: not done.

FIG. 14 shows example of spread kinetics in cell culture after transfection of RNA transcripts of Y93H resistance mutants. RNA transcripts of NS5A recombinants with and without Y93H resistance mutation were transfected into Huh7.5 cells. After immunostaining, the percentage of HCV Core positive cells was scored using confocal fluorescence microscopy.

FIG. 15 shows response to IFN-alpha treatment for J6/JFH1 recombinants with NS5A from different genotypes. Huh7.5 cells were infected with J6/JFH1 with NS5A of the indicated isolate (or ISDR type). J6/JFH1 was included with two infectious doses to control for impact of dose variability. The infectious dose of other recombinants was in the range between. Cultures were treated with IFN-alpha 2b at the given dose one and two days after infection. On day three cells were fixed and immunostained for NS3 expression. The number of single infected cells was determined by automated counting of individual wells. Values are shown as percentage infected cells compared to the average for non-treated controls of the given recombinant. Data were fitted to a sigmoidal dose-response curve with the equation $Y=1/(1+10^{((Log(EC_{50})-Log(IU/mL))*HillSlope)})$, where Y is the response in %.

FIG. 17 shows HCV infectivity titers after transfection of RNA transcripts of J6/JFH1-based genotype 1a recombinants into Huh7.5 hepatoma cells.

FIG. 18 shows HCV infectivity titers after transfection of RNA transcripts of J6/JFH1-based genotype is recombinants into Huh7.5 hepatoma cells.

DETAILED DESCRIPTION OF THE INVENTION

The present invention advantageously provides hepatitis C virus (HCV) nucleotide sequences capable of replication, expression of functional HCV proteins, and infection in vivo and in vitro for development of antiviral therapeutics and diagnostics.

In particular the present invention provides HCV recombinants expressing NS5A from genotype 1a, 1b, 2a, 3a, 4a, 5a, 6a or 7a in the context of a genotype 2a backbone. Additional recombinants express NS5A and the structural proteins (Core, E1 and E2), p7 and NS2 from genotype 1a, 1b, 3a, 4a, 5a, 6a or 7a in the genotype 2a backbone. Thus, the invention is a research tool of significant importance for genotype specific screening of HCV NS5A drug candidates and for functional studies of the NS5A gene and encoded protein. Since the system recapitulates the complete viral life cycle and express NS5A from genotypes 1-7, it is superior to existing systems in screening of drug candidates and functional analyses of NS5A.

So far, NS5A research has relied on the JFH1 cell culture system and particularly on replicon systems, in which only the genome replication part of the HCV lifecycle can be studied, while e.g. production of infectious particles cannot. The replicon system have only been reported for isolates of genotypes 1 and 2. Furthermore, it cannot be expected that findings in such incomplete systems can be directly transferred to the in vivo situation. This invention provides NS5A in vitro systems resembling in vivo conditions to a far higher degree than existing replicon systems. Culture systems expressing NS5A of all major HCV genotypes are of significant importance considering the increasing interest in development of specific NS5A inhibitors in the evolving field of HCV drug candidates. The NS3 protease, the NS5B polymerase and NS5A are the most promising targets in HCV drug development, the first NS5A inhibitors are currently in clinical trials, and a number of patents have been pursued for NS5A inhibitor compounds (Schmitz et al. 2008).

NOMENCLATURE AND DEFINITIONS

In all following text, figures and tables, JFH1-recombinants in which the structural genes (Core, E1 and E2), p7 and the non-structural gene NS2 of JFH1 are replaced by corresponding sequence from another isolate (XX) are named XX/JFH1. Recombinants that additionally have the NS5A gene of JFH1 replaced by another isolate (YY, in which XX and YY might be the same isolate) are named XX/JFH1(YY-NS5A). In cases where XX/JFH1 recombinants originally having adaptive mutations (aa) for efficient growth in cell culture are used for NS5A exchange studies, these original mutations adaptive for the XX/JFH1 construct are given immediately after the original name, and before the NS5A-addition: $XX/JFH1_{aa}$(YY-NS5A). For recombinants that have mutations adaptive for the exchanged NS5A gene (bb), the novel mutations are given at the very end of the name, e.g. XX/JFH1 $(YY\text{-}NS5A)_{bb}$, $XX/JFH1_{aa}(YY\text{-}NS5A)_{bb}$. All numbering of mutations are referring to the absolute position on the given genome. As an exemption, mutations in NS5A relevant for all genotypes (e.g. resistance mutations) are given a unique position numbering according to H77 NS5A to avoid confusion, and is placed in brackets after the recombinant name (e.g. XX/JFH1(YY-NS5A)[Y93H]). For cross comparison, H77 reference numbering is given in Tables 4-19.

In the present context the term "genotype" is to be understood in accordance with Simmonds et al. 2005—i.e. the term "genotype" relate to the presently 7 identified major HCV genotypes.

In the present context the term "subtype" is to be understood in accordance with Simmonds et al. 2005.

In the present context the term "isolate" is to be understood in accordance with Simmonds et al. 2005. Several different isolates/strains exist within the same subtype. The terms "isolate" and "strain" are used herein interchangeably.

In the present context, the phrase "operably linked" refers to the joining of nucleic acid sequences such that one sequence can provide a required function to a linked sequence. In the context of a promoter, "operably linked" means that the promoter is connected to a sequence of interest such that the transcription of that sequence of interest is controlled and regulated by that promoter. In the context of a selectable marker or reporter gene, "operably linked" means that the selectable marker or reporter gene is connected to a sequence of interest such that one can select or score for the presence of the sequence of interest. In the context of viral proteins that are encoded by a viral RNA as a polyprotein, "operably linked" means that the coding regions for each viral protein are linked such that the encoded polyprotein can be cleaved by proteases to yield functional viral proteins. In the context of a viral 5'UTR or 3'UTR sequence, "operably linked" means that these sequences are linked to other viral sequences so as to provide for replication and/or infectivity.

Nucleic Acid Molecules (cDNA Clones and RNA Transcripts)

In a broad aspect, the present invention is directed to a genetically engineered hepatitis C virus (HCV) encoded by nucleic acid sequences such as a complementary DNA (cDNA) sequence and replicating RNA comprising the structural genes (Core, E1 and E2), p7 and the non-structural gene NS2 from the human hepatitis C virus genotype 2a strain J6 and NS3, NS4A, NS4B and NS5B from the human hepatitis C virus genotype 2a strain JFH1 and the non-structural gene NS5A from the human hepatitis C virus genotype selected from the group consisting of 1a, 1b, 2a, 3a, 4a, 5a, 6a and 7a with the proviso that the NS5A gene from genotype 2a strain is not JFH1.

In one embodiment the present invention relates to a replicating RNA wherein the structural genes (Core, E1 and E2), p7 and NS2 are selected from the group consisting of genotypes 1a, 1b, 2a, 3a, 4a, 5a, 6a and 7a and wherein the genotype of Core-NS2 correspond to that selected of the NS5A genotype.

In another embodiment the genotype 1a is of the strain H77 or TN, wherein the genotype 1b is of the strain J4, wherein the genotype 2a is of the strain J6, wherein the genotype 3a is of the strain S52, wherein the genotype 4a is of the strain ED43, wherein the genotype 5a is of the strain SA13, wherein the genotype 6a is of the strain HK6a and wherein the genotype 7a is of the strain QC69.

In yet another embodiment the genotype 1a is of the strain DH6, wherein the genotype 1b is of the strain DH1, DH5 or Con-1, wherein the genotype 2b is of the strain 38, wherein the genotype 3a is of the strain DBN, DH11 or 452.

Recombinants expressing NS5A from genotype 1a, 1b, 2a, 3a, 4a, 5a, 6a and 7a.

The present invention pertains to HCV recombinants expressing NS5A from genotype 1a, 1b, 2a, 3a, 4a, 5a, 6a and 7a in the context of the genotype 2a backbone.

Thus, the invention provides an isolated nucleic acid molecule, which encodes human hepatitis C virus of a strain selected from the group consisting of: J6/JFH1 (H77-NS5A), J6/JFH1 (TN-NS5A), J6/JFH1 (J4-NS5A), J6/JFH1 (36-NS5A), J6/JFH1 (S52-NS5A), J6/JFH1 (ED43-NS5A), J6/JFH1 (SA13-NS5A), J6/JFH1 (HK6a-NS5A) and J6/JFH1 (QC69-NS5A). In one embodiment the nucleic acid molecule is capable of expressing said virus, when transfected into cells.

In one embodiment the nucleic acid molecule of the present invention comprises the nucleic acid sequence (cDNA) of J6/JFH1(H77-NS5A), SEQ ID NO 1. In yet an embodiment the nucleic acid molecule comprises the nucleic acid sequence with a sequence identity of at least 90% to that of SEQ ID NO 1.

In one embodiment the nucleic acid molecule of the present invention comprises the nucleic acid sequence (cDNA) of J6/JFH1(TN-NS5A), SEQ ID NO 3. In yet an embodiment the nucleic acid molecule comprises the nucleic acid sequence with a sequence identity of at least 90% to that of SEQ ID NO 3.

In one embodiment the nucleic acid molecule of the present invention comprises the nucleic acid sequence (cDNA) of J6/JFH1(J4-NS5A), SEQ ID NO 5. In yet an embodiment the nucleic acid molecule comprises the nucleic acid sequence with a sequence identity of at least 90% to that of SEQ ID NO 5.

In one embodiment the nucleic acid molecule of the present invention comprises the nucleic acid sequence (cDNA) of J6/JFH1(J6-NS5A), SEQ ID NO 11. In yet an embodiment the nucleic acid molecule comprises the nucleic acid sequence with a sequence identity of at least 90% to that of SEQ ID NO 11.

In one embodiment the nucleic acid molecule of the present invention comprises the nucleic acid sequence (cDNA) of J6/JFH1(S52-NS5A), SEQ ID NO 13. In yet an embodiment the nucleic acid molecule comprises the nucleic acid sequence with a sequence identity of at least 90% to that of SEQ ID NO 13.

In one embodiment the nucleic acid molecule of the present invention comprises the nucleic acid sequence (cDNA) of J6/JFH1(ED43-NS5A), SEQ ID NO 24. In yet an embodiment the nucleic acid molecule comprises the nucleic acid sequence with a sequence identity of at least 90% to that of SEQ ID NO 24.

In one embodiment the nucleic acid molecule of the present invention comprises the nucleic acid sequence (cDNA) of J6/JFH1(SA13-NS5A), SEQ ID NO 33. In yet an embodiment the nucleic acid molecule comprises the nucleic acid sequence with a sequence identity of at least 90% to that of SEQ ID NO 33.

In one embodiment the nucleic acid molecule of the present invention comprises the nucleic acid sequence (cDNA) of J6/JFH1(HK6a-NS5A), SEQ ID NO 40. In yet an embodiment the nucleic acid molecule comprises the nucleic acid sequence with a sequence identity of at least 90% to that of SEQ ID NO 40.

In one embodiment the nucleic acid molecule of the present invention comprises the nucleic acid sequence (cDNA) of J6/JFH1(QC69-NS5A), SEQ ID NO 43. In yet an embodiment the nucleic acid molecule comprises the nucleic acid sequence with a sequence identity of at least 90% to that of SEQ ID NO 43.

In another embodiment, the nucleic acid comprises a sequence sharing at least 90% identity with that set forth in SEQ ID NO 1, 3, 5, 11, 13, 24, 33, 40 or 43, such as 90% identity, 91% identity, 92% identity, 93% identity, 94% identity, 95% identity, 96% identity, 97% identity, 98% identity, or 99% identity.

It should be noted that while SEQ ID NOs 1, 3, 5, 11, 13, 24, 33, 40 and 43 are DNA sequences, the present invention contemplates the corresponding RNA sequence, and DNA and RNA complementary sequences as well.

In another embodiment, the HCV nucleic acid is a DNA that codes on expression or after in vitro transcription for a replication-competent HCV RNA genome, or is itself a replication-competent HCV RNA genome.

In one embodiment, the HCV nucleic acids of the invention have a full-length sequence as depicted in or corresponding to SEQ ID NOs 1, 3, 5, 11, 13, 24, 33, 40 and 43.

Naturally, as noted above, the HCV nucleic acid sequence of the invention is selected from the group consisting of double stranded DNA, positive-sense cDNA, or negative-sense cDNA, or positive-sense RNA or negative-sense RNA or double stranded RNA. Thus, where particular sequences of nucleic acids of the invention are set forth, both DNA and corresponding RNA are intended, including positive and negative strands thereof.

In a further embodiment, the nucleic acid sequences of SEQ ID NOs 1, 3, 5, 11, 13, 24, 33, 40 and 43 or the said nucleic acid sequence with any mutation described in this document is obtained by any other means than what is described above.

The complementary DNA (cDNA) provided by the present invention encodes human hepatitis C virus of a strain selected from the group consisting of: J6/JFH1 (H77-NS5A), J6/JFH1 (TN-NS5A), J6/JFH1 (J4-NS5A), J6/JFH1 NS5A), J6/JFH1 (S52-NS5A), J6/JFH1 (ED43-NS5A), J6/JFH1 (SA13-NS5A), J6/JFH1 (HK6a-NS5A) and J6/JFH1 (QC69-NS5A), wherein said molecule is capable of expressing said virus when transfected into cells and further capable of infectivity in vivo and wherein J6/JFH1(H77-NS5A) encodes the amino acid sequence of SEQ ID NO 82, wherein J6/JFH1(TN-NS5A) encodes the amino acid sequence with a sequence identity of SEQ ID NO 84, wherein J6/JFH1(J4/NS5A) encodes the amino acid sequence of SEQ ID NO 86, wherein J6/JFH1(J6-NS5A) (2a/2a) encodes the amino acid sequence of SEQ ID NO 92, wherein J6/JFH1(S52-NS5A) encodes the amino acid sequence of SEQ ID NO 94, wherein J6/JFH1 (ED43-NS5A) encodes the amino acid sequence of SEQ ID NO 105, wherein J6/JFH1(SA13-NSA) encodes the amino acid sequence of SEQ ID NO 114, wherein J6/JFH1(HK6a-NS5A) encodes the amino acid sequence of SEQ ID NO 121, and wherein J6/JFH1(QC69/-NS5A) encodes the amino acid sequence of SEQ ID NO 124.

According to various aspects of the invention, HCV nucleic acid, including the polyprotein coding region, can be mutated or engineered to produce variants or derivatives with, e.g., silent mutations, conservative mutations, etc. In a further preferred aspect, silent nucleotide changes in the polyprotein coding regions (i.e., variations of the first, second or third base of a codon leading to a new codon that encodes the same amino acid) are incorporated as markers of specific HCV clones.

Thus, one aspect of the present invention relates to any of the amino acid sequences disclosed herein, such as but not limited to SEQ ID NO 82, 84, 86, 92, 94, 105, 114, 121 and 124.

In yet an embodiment the isolated nucleic acid molecule encodes the amino acid sequence with a sequence identity of at least 90% to that of SEQ ID NO 82, 84, 86, 92, 94, 105, 114, 121 and 124.

In another embodiment, the complementary DNA (cDNA) provided by the present invention encodes human hepatitis C virus of a strain selected from the group consisting of: J6/JFH1(H77-NS5A), J6/JFH1(TN-NS5A), J6/JFH1(J4-NS5A), J6/JFH1(J6-NS5A), J6/JFH1(S52-NS5A), J6/JFH1 (ED43-NS5A), J6/JFH1(SA13-NS5A), J6/JFH1(HK6a-NS5A) and J6/JFH1(QC69-NS5A),
wherein said molecule is capable of expressing said virus, when transfected into cells, and
wherein J6/JFH1(H77-NS5A) encodes the amino acid sequence with a sequence identity of at least 90% to that of SEQ ID NO 82,
wherein J6/JFH1(TN-NS5A) encodes the amino acid sequence with a sequence identity of at least 90% to that of SEQ ID NO 84,
wherein J6/JFH1(J4/NS5A) encodes the amino acid sequence with a sequence identity of at least 90% to that of SEQ ID NO 86,
wherein J6/JFH1(J6-NS5A) (2a/2a) encodes the amino acid sequence with a sequence identity of at least 90% to that of SEQ ID NO 92,
wherein J6/JFH1(S52-NS5A) encodes the amino acid sequence with a sequence identity of at least 90% to that of SEQ ID NO 94,
wherein J6/JFH1(ED43-NS5A) encodes the amino acid sequence with a sequence identity of at least 90% to that of SEQ ID NO 105,
wherein J6/JFH1(SA13-NSA) encodes the amino acid sequence with a sequence identity of at least 90% to that of SEQ ID NO 114,
wherein J6/JFH1(HK6a-NS5A) encodes the amino acid sequence with a sequence identity of at least 90% to that of SEQ ID NO 121, and
wherein J6/JFH1(QC69/-NS5A) encodes the amino acid sequence with a sequence identity of at least 90% to that of SEQ ID NO 124.

In a further embodiment the above mentioned molecules is capable of infectivity in vivo.

In another embodiment, the amino acid sequences comprises a sequence sharing at least 90% identity with that set forth in SEQ ID NO 82, 84, 86, 92, 94, 105, 114, 121 and 124, such as 90% identity, 91% identity, 92% identity, 93% identity, 94% identity, 95% identity, 96% identity, 97 identity, 98% identity, or 99% identity.

It is to be understood that a sequence identity of at least 90%, such as 90 identity, 91% identity, 92% identity, 93% identity, 94% identity, 95% identity, 96% identity, 97% identity, 98% identity, or 99% identity applies to all sequences disclosed in the present application.

Recombinants expressing NS5A and the structural genes (Core, E1 and E2), p7 and NS2 from genotype 1a, 1b, 3a, 4a, 5a, 6a and 7a The present invention pertains to HCV recombinants expressing NS5A and the structural genes (Core, E1 and E2), p7 and NS2 from genotype 1a, 1b, 3a, 4a, 5a, 6a and 7a in the context of the genotype 2a backbone.

Thus, the invention provides an isolated nucleic acid molecule, which encodes human hepatitis C virus of a strain selected from the group consisting of: H77/JFH1$_{[T2700C,A4080T]}$(H77-NS5A), TN/JFH1$_{[C4562T]}$(TN-NS5A), J4/JFH1$_{[T2996C,A4827T]}$(J4-NS5A), S52/JFH1$_{[T2718G,A4550C]}$(S52-NS5A), ED43/JFH1$_{[A2819G,A3269T]}$(ED43-NS5A), SA13/JFH1$_{[C3405G,A3696G]}$(SA13-NS5A), HK6a/JFH1$_{[T1389C,A1590C]}$(HK6a-NS5A) and QC69/JFH1$_{[T2985C]}$(QC69-NS5A). In one embodiment the nucleic acid molecule is capable of expressing said virus, when transfected into cells.

In one embodiment the nucleic acid molecule of the present invention comprises the nucleic acid sequence (cDNA) of H77/JFH1$_{[T2700C,A4080T]}$(H77-NS5A), SEQ ID NO 44. In yet an embodiment the nucleic acid molecule comprises the nucleic acid sequence with a sequence identity of at least 90% to that of SEQ ID NO 44.

In one embodiment the nucleic acid molecule of the present invention comprises the nucleic acid sequence (cDNA) of TN/JFH1$_{[C4562T]}$(TN-NS5A), SEQ ID NO 46. In yet an embodiment the nucleic acid molecule comprises the nucleic acid sequence with a sequence identity of at least 90% to that of SEQ ID NO 46.

In one embodiment the nucleic acid molecule of the present invention comprises the nucleic acid sequence (cDNA) of J4/JFH1$_{[T2996C,A4827T]}$(J4-NS5A), SEQ ID NO 47. In yet an embodiment the nucleic acid molecule comprises the nucleic acid sequence with a sequence identity of at least 90% to that of SEQ ID NO 47.

In one embodiment the nucleic acid molecule of the present invention comprises the nucleic acid sequence (cDNA) of S52/JFH1$_{[T2718G,A4550C]}$(S52-NS5A), SEQ ID NO 49. In yet an embodiment the nucleic acid molecule comprises the nucleic acid sequence with a sequence identity of at least 90% to that of SEQ ID NO 49.

In one embodiment the nucleic acid molecule of the present invention comprises the nucleic acid sequence (cDNA) of ED43/JFH1$_{[A2819G,A3269T]}$(ED43-NS5A), SEQ ID NO 52. In yet an embodiment the nucleic acid molecule comprises the nucleic acid sequence with a sequence identity of at least 90% to that of SEQ ID NO 52.

In one embodiment the nucleic acid molecule of the present invention comprises the nucleic acid sequence (cDNA) of SA13/JFH1$_{[C3405G,A3696G]}$(SA13-NS5A), SEQ ID NO 54. In yet an embodiment the nucleic acid molecule comprises the nucleic acid sequence with a sequence identity of at least 90% to that of SEQ ID NO 54.

In one embodiment the nucleic acid molecule of the present invention comprises the nucleic acid sequence (cDNA) of HK6a/JFH1$_{[T1389C,A1590C]}$(HK6a-NS5A), SEQ ID NO 56. In yet an embodiment the nucleic acid molecule comprises the nucleic acid sequence with a sequence identity of at least 90% to that of SEQ ID NO 56.

In one embodiment the nucleic acid molecule of the present invention comprises the nucleic acid sequence (cDNA) of QC69/JFH1$_{[T2985C]}$(QC69-NS5A), SEQ ID NO 58. In yet an embodiment the nucleic acid molecule comprises the nucleic acid sequence with a sequence identity of at least 90% to that of SEQ ID NO 58.

The recombinants H77/JFH1$_{[T2700C,A4080T]}$(H77-NS5A), TN/JFH1$_{[C4562T]}$(TN-NS5A), J4/JFH1$_{[T2996C,A4827T]}$(J4-NS5A), S52/JFH1$_{[T2718G,A4550C]}$(S52-NS5A), ED43/JFH1$_{[A2819G,A3269T]}$(ED43-NS5A), SA13/JFH1$_{[C3405G,A3696G]}$(SA13-NS5A), HK6a/JFH1$_{[T1389C,A1590C]}$(HK6a-NS5A) and QC69/JFH1$_{[T2985C]}$(QC69-NS5A) comprise original mutations which are adaptive for the given recombinant with JFH1 NS5A. For most of these systems alternative sets of adaptive mutations could be used for efficient growth, as it has been demonstrated (Gottwein et al. 2007, Scheel et al. 2008, Jensen et al. 2008 and Gottwein et al. 2009).

Thus, in another embodiment, the JFH1-based Core-NS2 recombinants of genotype 1a, 1b, 3a, 4a, 5a, 6a and 7a used as backbone for the NS5A construct harbour different adaptive mutations than the ones given here.

In another embodiment, the nucleic acids comprises a sequence sharing at least 90% identity with that set forth in SEQ ID NO 44, 46, 47, 49, 52, 54, 56 and 58, such as 90% identity, 91% identity, 92% identity, 93 identity, 94% identity, 95% identity, 96% identity, 97% identity, 98% identity, or 99% identity.

It should be noted that while SEQ ID NOs 44, 46, 47, 49, 52, 54, 56 and 58 are a DNA sequences, the present invention contemplates the corresponding RNA sequence, and DNA and RNA complementary sequences as well.

In another embodiment, the HCV nucleic acid is a DNA that codes on expression or after in vitro transcription for a replication-competent HCV RNA genome, or is itself a replication-competent HCV RNA genome.

In one embodiment, the HCV nucleic acids of the invention have a full-length sequence as depicted in or corresponding to SEQ ID NOs 44, 46, 47, 49, 52, 54, 56 and 58.

Naturally, as noted above, the HCV nucleic acid sequence of the invention is selected from the group consisting of double stranded DNA, positive-sense cDNA, or negative-sense cDNA, or positive-sense RNA or negative-sense RNA or double stranded RNA. Thus, where particular sequences of nucleic acids of the invention are set forth, both DNA and corresponding RNA are intended, including positive and negative strands thereof.

In a further embodiment, the nucleic acid sequences of SEQ ID NOs 44, 46, 47, 49, 52, 54, 56 and 58 or the said nucleic acid sequence with any mutation described in this document is obtained by any other means than what is described above.

The complementary DNA (cDNA) provided by the present invention encodes human hepatitis C virus of a strain selected from the group consisting of: H77/JFH1$_{[T2700C,A4080T]}$ (H77-NS5A), TN/JFH1$_{[C4562T]}$(TN-NS5A), J4/JFH1$_{[T2996C,A4827T]}$(J4-NS5A), S52/JFH1$_{[T2718G,A4550C]}$ (S52-NS5A), ED43/JFH1$_{[A2819G,A3269T]}$(ED43-NS5A), SA13/JFH1$_{[C3405G,A3696G]}$(SA13-NS5A), HK6a/JFH1$_{[T1389C,A1590C]}$(HK6a-NS5A) and QC69/JFH1$_{[T2985C]}$ (QC69-NS5A), wherein said molecule is capable of expressing said virus when transfected into cells and further capable of infectivity in vivo and wherein H77/JFH1$_{[T2700C,A4080T]}$ (H77-NS5A) encodes the amino acid sequence of SEQ ID NO 125, wherein TN/JFH1$_{[C4562T]}$(TN-NS5A) encodes the amino acid sequence with a sequence identity of SEQ ID NO 127, wherein J4/JFH1$_{[T2996C,A4827T]}$(J4-NS5A) encodes the amino acid sequence of SEQ ID NO 128, wherein S52/JFH1$_{[T2718G,A4550C]}$(S52-NS5A) encodes the amino acid sequence of SEQ ID NO 130, wherein ED43/JFH1$_{[A2819G,A3269T]}$(ED43-NS5A) encodes the amino acid sequence of SEQ ID NO 133, wherein SA13/JFH1$_{[C3405G,A3696G]}$(SA13-NS5A) encodes the amino acid sequence of SEQ ID NO 135, wherein HK6a/JFH1$_{[T1389C,A1590C]}$(HK6a-NS5A) encodes the amino acid sequence of SEQ ID NO 137, and wherein QC69/JFH1$_{[T2985C]}$(QC69-NS5A) encodes the amino acid sequence of SEQ ID NO 139.

According to various aspects of the invention, HCV nucleic acid, including the polyprotein coding region, can be mutated or engineered to produce variants or derivatives with, e.g., silent mutations, conservative mutations, etc. In a further preferred aspect, silent nucleotide changes in the polyprotein coding regions (i.e., variations of the first, second or third base of a codon leading to a new codon that encodes the same amino acid) are incorporated as markers of specific HCV clones.

Thus, one aspect of the present invention relates to any of the amino acid sequences disclosed herein, such as but not limited to SEQ ID NO 125, 127. 128. 130, 133, 135, 137 and 139.

In yet an embodiment the isolated nucleic acid molecule encodes the amino acid sequence with a sequence identity of at least 90% to that of SEQ ID NO 125, 127. 128. 130, 133, 135, 137 and 139.

In another embodiment, the complementary DNA (cDNA) provided by the present invention encodes human hepatitis C virus of a strain selected from the group consisting of: H77/JFH1$_{[T2700C,A4080T]}$(H77-NS5A), TN/JFH1$_{[C4562T]}$(TN-NS5A), J4/JFH1$_{[T2996C,A4827T]}$(J4-NS5A), S52/JFH1$_{[T2718G,A4550C]}$(S52-NS5A), ED43/JFH1$_{[A2819G,A3269T]}$(ED43-NS5A), SA13/JFH1$_{[C3405G,A3696G]}$(SA13-NS5A), HK6a/JFH1$_{[T1389C,A1590C]}$(HK6a-NS5A) and QC69/JFH1$_{[T2985C]}$ (QC69-NS5A)

wherein said molecule is capable of expressing said virus, when transfected into cells, and wherein H77/JFH1$_{[T2700C,A4080T]}$(H77-NS5A) encodes the amino acid sequence with a sequence identity of at least 90% to that of SEQ ID NO 125, wherein TN/JFH1$_{[C4562T]}$(TN-NS5A) encodes the amino acid sequence with a sequence identity of at least 90% to that of SEQ ID NO 127, wherein J4/JFH1$_{[T2996C,A4827T]}$(J4-NS5A) encodes the amino acid sequence with a sequence identity of at least 90% to that of SEQ ID NO 128, wherein S52/JFH1$_{[T2718G,A4550C]}$(S52-NS5A) encodes the amino acid sequence with a sequence identity of at least 90% to that of SEQ ID NO 130, wherein ED43/JFH1$_{[A2819G,A3269T]}$(ED43-NS5A) encodes the amino acid sequence with a sequence identity of at least 90% to that of SEQ ID NO 133, wherein SA13/JFH1$_{[C3405G,A3696G]}$(SA13-NS5A) encodes the amino acid sequence with a sequence identity of at least 90% to that of SEQ ID NO 135, wherein HK6a/JFH1$_{[T1389C,A1590C]}$(HK6a-NS5A) encodes the amino acid sequence with a sequence identity of at least 90% to that of SEQ ID NO 137, and wherein QC69/JFH1$_{[T2985C]}$(QC69-NS5A) encodes the amino acid sequence with a sequence identity of at least 90% to that of SEQ ID NO 139.

In a further embodiment the above mentioned molecules is capable of infectivity in vivo.

In another embodiment, the amino acid sequences comprises a sequence sharing at least 90% identity with that set forth in SEQ ID NO 125, 127. 128. 130, 133, 135, 137 and 139, such as 90% identity, 91% identity, 92% identity, 93% identity, 94% identity, 95% identity, 96% identity, 97% identity, 98% identity, or 99% identity.

It is to be understood that a sequence identity of at least 90%, such as 90 identity, 91% identity, 92% identity, 93% identity, 94% identity, 95 identity, 96% identity, 97% identity, 98% identity, or 99% identity applies to all sequences disclosed in the present application.

As commonly defined "identity" is here defined as sequence identity between genes or proteins at the nucleotide or amino acid level, respectively.

Thus, in the present context "sequence identity" is a measure of identity between proteins at the amino acid level and a measure of identity between nucleic acids at nucleotide level. The protein sequence identity may be determined by comparing the amino acid sequence in a given position in each sequence when the sequences are aligned. Similarly, the nucleic acid sequence identity may be determined by comparing the nucleotide sequence in a given position in each sequence when the sequences are aligned To determine the percent identity of two amino acid sequences or of two nucleic acids, the sequences are aligned for optimal comparison purposes (e.g., gaps may be introduced in the sequence of a first amino acid or nucleic acid sequence for optimal alignment with a second amino or nucleic acid sequence). The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position. The percent identity between the two sequences is a function of the number of identical positions shared by the sequences (i.e., % identity=# of identical positions/total # of positions (e.g., overlapping positions)×100). In one embodiment the two sequences are the same length.

One may manually align the sequences and count the number of identical amino acids. Alternatively, alignment of two sequences for the determination of percent identity may be accomplished using a mathematical algorithm. Such an algorithm is incorporated into the NBLAST and XBLAST programs of (Altschul et al. 1990). BLAST nucleotide searches may be performed with the NBLAST program, score=100, wordlength=12, to obtain nucleotide sequences homologous to a nucleic acid molecules of the invention. BLAST protein searches may be performed with the XBLAST program, score=50, wordlength=3 to obtain amino acid sequences homologous to a protein molecule of the invention. To obtain gapped alignments for comparison purposes, Gapped BLAST may be utilised. Alternatively, PSI-Blast may be used to perform an iterated search which detects distant relationships between molecules. When utilising the NBLAST, XBLAST, and Gapped BLAST programs, the default parameters of the respective programs may be used. See http://internet location www.ncbi.nlm.nih.gov. Alternatively, sequence identity may be calculated after the sequences have been aligned e.g. by the BLAST program in the EMBL database (internet location of www.ncbi.nlm.gov/cgi-bin/BLAST). Generally, the default settings with respect to e.g. "scoring matrix" and "gap penalty" may be used for alignment. In the context of the present invention, the BLASTN and PSI BLAST default settings may be advantageous.

The percent identity between two sequences may be determined using techniques similar to those described above, with or without allowing gaps. In calculating percent identity, only exact matches are counted.

In one embodiment the present invention provides a cassette vector for cloning viral genomes, comprising, inserted therein, the nucleic acid sequence according to the invention and having an active promoter upstream thereof.

Adaptive Mutations

Adapted mutants of a HCV-cDNA construct or HCV-RNA full-length genome with improved abilities to generate infectious viral particles in cell culture compared to the original HCV-cDNA construct or the original HCV-RNA full-length genome are characterized in that they are obtainable by a method in which the type and number of mutations in a cell culture adapted HCV-RNA genome are determined through sequence analysis and sequence comparison and these mutations are introduced into a HCV-cDNA construct, particularly a HCV-cDNA construct according to the present invention, or into an (isolated) HCV-RNA full-length genome, either by site-directed mutagenesis, or by exchange of DNA fragments containing the relevant mutations.

The present inventors here report adaptive mutations, which allow efficient formation and release of viral particles in cell culture, and thus the present invention relates to these adaptive mutations in the present use as well as use in other strains by changing equivalent positions of such genomes to the adapted nucleotide or amino acid described.

As mentioned in the part pertaining to "nomenclature" the recombinants H77/JFH1$_{[T2700C,A4080T]}$(H77-NS5A), TN/JFH1$_{[C4562T]}$(TN-NS5A), J4/JFH1$_{[T2996C,A4827T]}$(J4-

NS5A), S52/JFH1$_{[T2718G,A4550C]}$(S52-NS5A), ED43/JFH1$_{[A2819G,A3269T]}$(ED43-NS5A), SA13/JFH1$_{[C3405G,A3696G]}$(SA13-NS5A), HK6a/JFH1$_{[T1389C,A1590C]}$(HK6a-NS5A) and QC69/JFH1$_{[T2985C]}$ (QC69-NS5A) comprise original mutations which are adaptive for the given recombinant with JFH1 NS5A—however some of these constructs where the NS5A gene has been exchanged by the genotype of interest also acquire additional adaptive mutations upon viral passage. Such mutations can enhance viral growth characteristics.

A group of preferred HCV-cDNA constructs, HCV-RNA full-length genomes with the ability to release viral particles in cell culture, which are consequently highly suitable for practical use, is characterized in that it contains one, several or all of the nucleic acid exchanges listed below and/or one or several or all of the following amino acid exchanges.

One embodiment of the present invention relates to adaptive mutations, wherein the adaptive mutation is a mutation that can be observed by clonal or direct sequencing of recovered replicating genomes of SEQ ID NOs 1, 3, 5, 11, 13, 24, 33, 40 and 43 as well as 44, 46, 47, 49, 52, 54, 56 and 58.

Thus in a further embodiment, the present invention relates to nucleic acid molecules according to the present invention (i.e. recombinants expressing NS5A from genotype 1a, 1b, 2a, 3a, 4a, 5a, 6a and 7a and recombinants expressing NS5A and the non structural genes (Core, E1 and E2), p7 and NS2 from genotype 1, 1b, 3a, 4a, 5a, 6a and 7a), wherein said molecule comprises one or more adaptive mutations in p7, NS2, NS3 and/or NS5A singly or in combination.

In the context of the present invention the term "adaptive mutation" is meant to cover mutations identified in passaged (i) J6/JFH1 (H77-NS5A), J6/JFH1 (TN-NS5a), J6/JFH1 (J4-NS5A), J6/JFH1 (J6-NS5A), J6/JFH1 (S52-NS5A), J6/JFH1 (ED43-NS5A), J6/JFH1 (SA13-NS5A), J6/JFH1 (HK6a-NS5A) and J6/JFH1 (QC69-NS5A) and (ii) H77/JFH1$_{[T2700C,A4080T]}$(H77-NS5A), TN/JFH1$_{[C4562T]}$(TN-NS5A), J4/JFH1$_{[T2996C,A4827T]}$(J4-NS5A), S52/JFH1$_{[T2718G,A4550C]}$(S52-NS5A), ED43/JFH1$_{[A2819G,A3269T]}$(ED43-NS5A), SA13/JFH1$_{[C3405G,A3696G]}$(SA13-NS5A), HK6a/JFH1$_{[T1389C,A1590C]}$(HK6a-NS5A) and QC69/JFH1$_{[T2985C]}$(QC69-NS5A) viruses that provide the original (i) J6/JFH1 (H77-NS5A), J6/JFH1 (TN-N55a), J6/JFH1 (J4-NS5A), J6/JFH1 (J6-NS5A), J6/JFH1 (S52-NS5A), J6/JFH1 (ED43-NS5A), J6/JFH1 (SA13-NS5A), J6/JFH1 (HK6a-NS5A) and J6/JFH1 (QC69-NS5A) and (ii) H77/JFH1$_{[T2700C,A4080T]}$(H77-NS5A), TN/JFH1$_{[C4562T]}$(TN-NS5A), J4/JFH1$_{[T2996C,A4827T]}$(J4-NS5A), S52/JFH1$_{[T2718G,A4550C]}$(S52-NS5A), ED43/JFH1$_{[A2819G,A3269T]}$(ED43-NS5A), SA13/JFH1$_{[C3405G,A3696G]}$(SA13-NS5A), HK6a/JFH1$_{[T1389C,A1590C]}$(HK6a-NS5A) and QC69/JFH1$_{[T2985C]}$(QC69-NS5A) and any other HCV sequence the ability to grow efficiently in culture.

Furthermore all introductions of mutations into the (i) J6/JFH1 (H77-NS5A), J6/JFH1 (TN-NS5a), J6/JFH1 (J6-NS5A), J6/JFH1 (J6-NS5A), J6/JFH1 (S52-NS5A), J6/JFH1 (ED43-NS5A), J6/JFH1 (SA13-NS5A), J6/JFH1 (HK6a-NS5A) and J6/JFH1 (QC69-NS5A) and (ii) H77/JFH1$_{[T2700C,A4080T]}$(H77-NS5A), TN/JFH1$_{[C4562T]}$(TN-NS5A), J4/JFH1$_{[T2996C,A4827T]}$(J4-NS5A), S52/JFH1$_{[T2718G,A4550C]}$(S52-NS5A), ED43/JFH1$_{[A2819G,A3269T]}$(ED43-NS5A) SA13/JFH1$_{[C3405G,A3696G]}$(SA13-NS5A), HK6a/JFH1$_{[T1389C,A1590C]}$(H K6a-NS5A) and QC69/JFH1$_{[T2985C]}$(QC69-NS5A) sequences described, whether or not yielding better growth abilities, and the introduction of these mutations into any HCV sequence should be considered.

Thus the described mutations enable the HCV-RNA genome (e.g. derived from a HCV-cDNA clone) to form viral particles in and release these from suitable cell lines. In addition some of the described mutations might change the function of the concerned proteins in favourable ways, which might be exploited in other experimental systems employing these proteins. This also includes other HCV genomes with adaptive mutations, all of them, combinations of them or individual mutations that grow in culture. In this case the titers might be lower than those listed.

It should be understood that any feature and/or aspect discussed above in connection with the mutations according to the invention apply by analogy to both single mutations and any combination of the mutations.

Adaptive mutations in recombinants expressing NS5A from genotype 1a, 1b, 2a, 3a, 4a, 5a, 6a and 7

When sequencing the HCV genomes from the supernatants of J6/JFH1 (J4-NS5A), J6/JFH1 (J6-NS5A), J6/JFH1 (S52-NS5A), J6/JFH1 (ED43-NS5A), J6/JFH1 (SA13-NS5A) and J6/JFH1 (HK6a-NS5A) changes at the nucleotide level were observed at least once. A number of these were tested in reverse genetic studies (see Examples 1-10). In addition, putative adaptive mutations found for other NS5A recombinants were tested in selected cases Thus, in one embodiment the present invention pertains to a nucleic acid molecule wherein J6/JFH1 (H77-NS5A), J6/JFH1 (TN-NS5a), J6/JFH1 (J4-NS5A), J6/JFH1 (J6-NS5A), J6/JFH1 (S52-NS5A), J6/JFH1 (ED43-NS5A), J6/JFH1 (SA13-NS5A), J6/JFH1 (HK6a-NS5A) and J6/JFH1 (QC69-NS5A) comprises one or more adaptive mutations in p7, NS2, NS3 and/or NS5A.

In another embodiment said one or more adaptive mutations in J6/JFH1 (H77-NS5A) is at least one of the replacements of the first said nucleotide of SEQ ID NO 1 by the following said nucleotide selected from the group consisting of T2667C, A4032T, A4727T, T4888C A5195G, C6330T, A7266T, T7607C, T9326C.

In another embodiment said one or more adaptive mutations in J6/JFH1 (H77-NS5A) is at least one of the replacements of the first said nucleotide of SEQ ID NO 1 by the following said nucleotide selected from the group consisting of T2667C.

In another embodiment said one or more adaptive mutations in J6/JFH1 (TN-NS5A) is at least one of the replacements of the first said nucleotide of SEQ ID NO 3 by the following said nucleotide selected from the group consisting of T1762C, T2667C, A4286G, T6749C, A7266T, G7595A.

In another embodiment said one or more adaptive mutations in J6/JFH1 (TN-NS5A) is at least one of the replacements of the first said nucleotide of SEQ ID NO 3 by the following said nucleotide selected from the group consisting of T2667C.

In another embodiment said one or more adaptive mutations in J6/JFH1 (J4-NS5A) is at least one of the replacements of the first said nucleotide of SEQ ID NO 5 by the following said nucleotide selected from the group consisting of T2667C, G2952A, T3905A, A3952G, C6504T, C7308T, A7844G.

In another embodiment said one or more adaptive mutations in J6/JFH1 (J4-NS5A) is at least one of the replacements of the first said nucleotide of SEQ ID NO 5 by the following said nucleotide selected from the group consisting of T2667C, G2952A and T3905A.

In another embodiment said one or more adaptive mutations in J6/JFH1 (J4-NS5A) is at least one of the replacements of the first said nucleotide of SEQ ID NO 5 by the following said nucleotide selected from the group consisting of T3905A.

In another embodiment said one or more adaptive mutations in J6/JFH1 (J6-NS5A) is at least one of the replacements of the first said nucleotide of SEQ ID NO 11 by the following said nucleotide selected from the group consisting of T2667C, C6820A, A7334G.

In another embodiment said one or more adaptive mutations in J6/JFH1 NS5A) is at least one of the replacements of the first said nucleotide of SEQ ID NO 11 by the following said nucleotide selected from the group consisting of T2667C.

In another embodiment said one or more adaptive mutations in J6/JFH1(S52-NS5A) is at least one of the replacements of the first said nucleotide of SEQ ID NO 13 by the following said nucleotide selected from the group consisting of T2667C, C2693G, G3473A, A3631G, A4862C, A6276G, A6577C and T7580C.

In another embodiment said one or more adaptive mutations in J6/JFH1(S52-NS5A) is at least one of the replacements of the first said nucleotide of SEQ ID NO 13 by the following said nucleotide selected from the group consisting of T2667C, C2693G, G3473A, A4862C, A6276G and T7580C.

In another embodiment said one or more adaptive mutations in J6/JFH1(S52-NS5A) is at least one of the replacements of the first said nucleotide of SEQ ID NO 13 by the following said nucleotide selected from the group consisting of C2693G, A4862C, A6276G and T7580C.

In another embodiment said one or more adaptive mutations in J6/JFH1(S52-NS5A) is at least one of the replacements of the first said nucleotide of SEQ ID NO 13 by the following said nucleotide selected from the group consisting of A6276G.

In another embodiment said one or more adaptive mutations in J6/JFH1(ED43-NS5A) is at least one of the replacements of the first said nucleotide of SEQ ID NO 24 by the following said nucleotide selected from the group consisting of T1170C, C1831T, A1948G, A2301C, A2482G, T2667C, A2682G, G2850T, T2930A, G2948A, T3050C, C3055T, T3211C, C3922T, A4101G, G5165A, C5199T, T5282C, A6185G, G6296A, T6303C, C6335A, A6454C, G6616A, G6967A, T7106C, A7143G, G7170A, A7587G, A7590G, T8691C, G9238A In another embodiment said one or more adaptive mutations in J6/JFH1(ED43-NS5A) is at least one of the replacements of the first said nucleotide of SEQ ID NO 24 by the following said nucleotide selected from the group consisting of T2667C, T5282C, A7143G and A7587G.

In another embodiment said one or more adaptive mutations in J6/JFH1(ED43-NS5A) is at least one of the replacements of the first said nucleotide of SEQ ID NO 24 by the following said nucleotide selected from the group consisting of T2667C, T5282C and A7143G.

In another embodiment said one or more adaptive mutations in J6/JFH1(SA13-NS5A) is at least one of the replacements of the first said nucleotide of SEQ ID NO 33 by the following said nucleotide selected from the group consisting of T1582G, A1674G, T1685G, A2377G, T2667C, T2705C, C2747T, T2865C, T3946C, T4314C, A6284G, C6689T, C7023T, T7157C, C7278T, A7604G, C7900G.

In another embodiment said one or more adaptive mutations in J6/JFH1(SA13-NS5A) is at least one of the replacements of the first said nucleotide of SEQ ID NO 33 by the following said nucleotide selected from the group consisting of T2667C, A6284G, C7023T, C7278T and A7604G.

In another embodiment said one or more adaptive mutations in J6/JFH1(SA13-NS5A) is at least one of the replacements of the first said nucleotide of SEQ ID NO 33 by the following said nucleotide selected from the group consisting of A6284G, and A7604G.

In another embodiment said one or more adaptive mutations in J6/JFH1(HK6a-NS5A) is at least one of the replacements of the first said nucleotide of SEQ ID NO 40 by the following said nucleotide selected from the group consisting of T2667C A5771G, T7155A, A7773G and T8110C.

In another embodiment said one or more adaptive mutations in J6/JFH1(HK6a-NS5A) is at least one of the replacements of the first said nucleotide of SEQ ID NO 40 by the following said nucleotide selected from the group consisting of T2667C and T7155A.

In another embodiment said one or more adaptive mutations in J6/JFH1(HK6a-NS5A) is at least one of the replacements of the first said nucleotide of SEQ ID NO 40 by the following said nucleotide selected from the group consisting of T7155A.

In another embodiment all the amino acid changes observed herein are provided by the present application. The skilled addressee can easily obtain the same amino acid change by mutating another base of the codon and hence all means of obtaining the given amino acid sequence is intended.

Thus, in one embodiment the present invention pertains to an amino acid sequence wherein said one or more adaptive mutations in J6/JFH1 (H77-NS5A) is at least one of the replacements of the first said amino acid of SEQ ID NO 82 by the following said amino acid selected from the group consisting of F776S, Y1231F, T1463S, K1619E, T1997I, D2309V and C2423R.

In another embodiment said one or more adaptive mutations in J6/JFH1 (H77-NS5A) is at least one of the replacements of the first said amino acid of SEQ ID NO 82 by the following said amino acid selected from the group consisting of F776S.

In another embodiment said one or more adaptive mutations in J6/JFH1 (TN-NS5A) is at least one of the replacements of the first said amino acid of SEQ ID NO 84 by the following said amino acid selected from the group consisting of F776S, I1316V, F2137L, D2309V, E2419K.

In another embodiment said one or more adaptive mutations in J6/JFH1 (TN-NS5A) is at least one of the replacements of the first said amino acid of SEQ ID NO 84 by the following said amino acid selected from the group consisting of F776S.

In another embodiment said one or more adaptive mutations in J6/JFH1 (J4-NS5A) is at least one of the replacements of the first said amino acid of SEQ ID NO 86 by the following said amino acid selected from the group consisting of F776S, R871H, C1189S, T2055I, T2323I and S2502G.

In another embodiment said one or more adaptive mutations in J6/JFH1 (J4-NS5A) is at least one of the replacements of the first said amino acid of SEQ ID NO 86 by the following said amino acid selected from the group consisting of F776S, R871H and C1189S.

In another embodiment said one or more adaptive mutations in J6/JFH1 (J4-NS5A) is at least one of the replacements of the first said amino acid of SEQ ID NO 86 by the following said amino acid selected from the group consisting of C1189S.

In another embodiment said one or more adaptive mutations in J6/JFH1(J6-NS5A) is at least one of the replacements of the first said amino acid of SEQ ID NO 92 by the following said amino acid selected from the group consisting of F776S and T2332A.

In another embodiment said one or more adaptive mutations in J6/JFH1(J6-NS5A) is at least one of the replacements of the first said amino acid of SEQ ID NO 92 by the following said amino acid selected from the group consisting of F776S.

In another embodiment said one or more adaptive mutations in J6/JFH1(S52-NS5A) is at least one of the replacements of the first said amino acid of SEQ ID NO 94 by the following said amino acid selected from the group consisting of F776S, R785G, G1045S, T1508P, D1979G and W2414R.

In another embodiment said one or more adaptive mutations in J6/JFH1(S52-NS5A) is at least one of the replacements of the first said amino acid of SEQ ID NO 94 by the following said amino acid selected from the group consisting of R785G, T1508P, D1979G and W2414R.

In another embodiment said one or more adaptive mutations in J6/JFH1(S52-NS5A) is at least one of the replacements of the first said amino acid of SEQ ID NO 94 by the following said amino acid selected from the group consisting of D1979G.

In another embodiment said one or more adaptive mutations in J6/JFH1(ED43-NS5A) is at least one of the replacements of the first said amino acid of SEQ ID NO 105 by the following said amino acid selected from the group consisting of V277A, D654A, F776S, Y781C, K837N, W864R, V870M, Y904H, K1254R, D1609N, P1620L, Y1648H, T1949A, D1986N, V1988A, L1999I, F2256L, E2268G, R2277H, E2416G, D2417G and I2784T.

In another embodiment said one or more adaptive mutations in J6/JFH1(ED43-NS5A) is at least one of the replacements of the first said amino acid of SEQ ID NO 105 by the following said amino acid selected from the group consisting of F776S, Y1648H, E2268G and E2416G.

In another embodiment said one or more adaptive mutations in J6/JFH1(ED43-NS5A) is at least one of the replacements of the first said amino acid of SEQ ID NO 105 by the following said amino acid selected from the group consisting of F776S, Y1648H and E2268G.

In another embodiment said one or more adaptive mutations in J6/JFH1(SA13-NS5A) is at least one of the replacements of the first said amino acid of SEQ ID NO 114 by the following said amino acid selected from the group consisting of H445R, S449A, F776S, L842P, V1325A, R1982G, P2117S, A2228V, S2273P, P2313L and S2422.

In another embodiment said one or more adaptive mutations in J6/JFH1(SA13-NS5A) is at least one of the replacements of the first said amino acid of SEQ ID NO 114 by the following said amino acid selected from the group consisting of F776S, R1982G, A2228V, P2313L and S2422G In another embodiment said one or more adaptive mutations in J6/JFH1(SA13-NS5A) is at least one of the replacements of the first said amino acid of SEQ ID NO 114 by the following said amino acid selected from the group consisting of R1982G and S2422G.

In another embodiment said one or more adaptive mutations in J6/JFH1(HK6a-NS5A) is at least one of the replacements of the first said amino acid of SEQ ID NO 121 by the following said amino acid selected from the group consisting of F776S, I1811V, I2272N and K2478R.

In another embodiment said one or more adaptive mutations in J6/JFH1(HK6a-NS5A) is at least one of the replacements of the first said amino acid of SEQ ID NO 121 by the following said amino acid selected from the group consisting of F776S and I2272N.

In another embodiment said one or more adaptive mutations in J6/JFH1(HK6a-NS5A) is at least one of the replacements of the first said amino acid of SEQ ID NO 121 by the following said amino acid selected from the group consisting of I2272N.

Adaptive mutations in recombinants expressing NS5A and the structural genes (Core, E1 and E2), p7 and NS2 from genotype 1a, 1b, 3a, 4a, 5a, 6a and 7.

When sequencing the HCV genomes from the supernatants of H77/JFH1$_{[T2700C,A4080T]}$(H77-NS5A), TN/JFH1$_{[C4562T]}$ (TN-NS5A), J4/JFH1$_{[T2996C,A4827T]}$(J4-NS5A), S52/JFH1$_{[T2718G,A4550C]}$(S52-NS5A), ED43/JFH1$_{[A2819G,A3269T]}$ (ED43-NS5A) and SA13/JFH1$_{[C3405G,A3696G]}$(SA13-NS5A), changes at the nucleotide level were observed at least one. A number of these were tested in reverse genetic studies (see Examples 1-10). In addition, putative adaptive mutations found for other NS5A recombinants were tested in selected cases.

Thus, in one embodiment the present invention pertains to a nucleic acid molecule wherein H77/JFH1$_{[T2700C,A4080T]}$ (H77-NS5A), TN/JFH1$_{[C4562T]}$(TN-NS5A), J4/JFH1$_{[T2996C,A4827T]}$(J4-NS5A), S52/JFH1$_{[T2718G,A4550C]}$ (S52-NS5A), ED43/JFH1$_{[A2819G,A3269T]}$(ED43-NS5A), SA13/JFH1$_{[C3405G,A3696G]}$(SA13-NS5A), HK6a/JFH1$_{[T1389C,A1590C]}$(HK6a-NS5A) and QC69/JFH1$_{[T2965C]}$ (QC69-NS5A) comprises one or more adaptive mutations in NS5A and/or NS3.

In another embodiment said one or more adaptive mutations in H77/JFH1$_{[T2700C,A4080T]}$(H77-NS5A) is at least one of the replacements of the first said nucleotide of SEQ ID NO 44 by the following said nucleotide selected from the group consisting of T1374C, T1383G, C2610T, T3893A, A4850C, G6402A, A9073C.

In another embodiment said one or more adaptive mutations in H77/JFH1$_{[T2700C,A4080T]}$(H77-NS5A) is at least one of the replacements of the first said nucleotide of SEQ ID NO 44 by the following said nucleotide selected from the group consisting of T3893A.

In another embodiment said one or more adaptive mutations in TN/JFH1$_{[C4562T]}$(TN-NS5A) is at least one of the replacements of the first said nucleotide of SEQ ID NO 46 by the following said nucleotide selected from the group consisting of C739T, T3534G, T3893A, A4274G and A6980G.

In another embodiment said one or more adaptive mutations in J4/JFH1$_{[T2996C,A4827T]}$(J4-NS5A) is at least one of the replacements of the first said nucleotide of SEQ ID NO 47 by the following said nucleotide selected from the group consisting of A3121C, T3814G, T3893A, T3877C, G4399A.

In another embodiment said one or more adaptive mutations in J4/JFH1$_{[T2996C,A4827T]}$(J4-NS5A) is at least one of the replacements of the first said nucleotide of SEQ ID NO 47 by the following said nucleotide selected from the group consisting of T3893A.

In another embodiment said one or more adaptive mutations in S52/JFH1$_{[T2718G,A4550C]}$(S52-NS5A) is at least one of the replacements of the first said nucleotide of SEQ ID NO 49 by the following said nucleotide selected from the group consisting of T7625C.

In another embodiment said one or more adaptive mutations in ED43/JFH1$_{[A2819G,A3269T]}$(ED43-NS5A) is at least one of the replacements of the first said nucleotide of SEQ ID NO 52 by the following said nucleotide selected from the group consisting of T865C, A1048G, T1404C, G1828A, A3332G, T4484C, T5270C, T6291C, A7131G, A7149G, G7547C, A8019G, C8266T, A8368G.

In another embodiment said one or more adaptive mutations in ED43/JFH1$_{[A2819G,A3269T]}$(ED43-NS5A) is at least one of the replacements of the first said nucleotide of SEQ ID NO 52 by the following said nucleotide selected from the group consisting of T5270C and A7131G.

In another embodiment said one or more adaptive mutations in SA13/JFH1$_{[C3405G,A3696G]}$(SA13-NS5A) is at least one of the replacements of the first said nucleotide of SEQ ID NO 54 by the following said nucleotide selected from the group consisting of A964G, G2634A, A3968T, A4537G, A6275G, G7136T, T7347A, T7599A, T7604C and T9005C.

In another embodiment said one or more adaptive mutations in SA13/JFH1$_{[C3405G,A3696G]}$(SA13-NS5A) is at least one of the replacements of the first said nucleotide of SEQ ID NO 54 by the following said nucleotide selected from the group consisting of A6275G and T7604C.

In another embodiment said one or more adaptive mutations in HK6a/JFH1$_{[T1389C,A1590C]}$(HK6a-NS5A) is at least one of the replacements of the first said nucleotide of SEQ ID NO 56 by the following said nucleotide selected from the group consisting of T7161A.

In another embodiment all the amino acid changes observed herein are provided by the present application. The skilled addressee can easily obtain the same amino acid change by mutating another base of the codon and hence all means of obtaining the given amino acid sequence is intended.

Thus, in one embodiment said one or more adaptive mutations in H77/JFH1$_{[T2700C,A4080T]}$(H77-NS5A) is at least one of the replacements of the first said amino acid of SEQ ID NO 125 by the following said amino acid selected from the group consisting of M345T, 1348S, A757V, C1185S, T1504P, G2021E and K2911N.

Thus, in one embodiment said one or more adaptive mutations in H77/JFH1$_{[T2700C,A4080T]}$(H77-NS5A) is at least one of the replacements of the first said amino acid of SEQ ID NO 125 by the following said amino acid selected from the group consisting of C1185S.

In another embodiment said one or more adaptive mutations in TN/JFH1$_{[C4562T]}$(TN-NS5A) is at least one of the replacements of the first said amino acid of SEQ ID NO 127 by the following said amino acid selected from the group consisting of V1065G, 11312V, C1185S and T2214A.

In another embodiment said one or more adaptive mutations in J4/JFH1$_{[T2996C,A4827T]}$(J4-NS5A) is at least one of the replacements of the first said amino acid of SEQ ID NO 128 by the following said amino acid selected from the group consisting of K927N, 11158M and C1185S.

In another embodiment said one or more adaptive mutations in J4/JFH1$_{[T2996C,A4827T]}$(J4-NS5A) is at least one of the replacements of the first said amino acid of SEQ ID NO 128 by the following said amino acid selected from the group consisting of C1185S.

In another embodiment said one or more adaptive mutations in S52/JFH1$_{[T2718G,A4550C]}$(S52-NS5A) is at least one of the replacements of the first said amino acid of SEQ ID NO 130 by the following said amino acid selected from the group consisting of C2429R.

In another embodiment said one or more adaptive mutations in ED43/JFH1$_{[A2819G,A3269T]}$(ED43-NS5A) is at least one of the replacements of the first said amino acid of SEQ ID NO 133 by the following said amino acid selected from the group consisting of V355A, R998G, Y1644H, V1984A, E2264G, E2270G, D2403H and E2560G.

In another embodiment said one or more adaptive mutations in ED43/JFH1$_{[A2819G,A3269T]}$(ED43-NS5A) is at least one of the replacements of the first said amino acid of SEQ ID NO 133 by the following said amino acid selected from the group consisting of Y1644H, E2264G.

In another embodiment said one or more adaptive mutations in SA13/JFH1$_{[C3405G,A3696G]}$(SA13-NS5A) is at least one of the replacements of the first said amino acid of SEQ ID NO 135 by the following said amino acid selected from the group consisting of N208D, G765E, T1210S, K1399E, R1979G, D2266Y, V2336E, V2420E and C2422R.

In another embodiment said one or more adaptive mutations in SA13/JFH1$_{[C3405G,A3696G]}$(SA13-NS5A) is at least one of the replacements of the first said amino acid of SEQ ID NO 135 by the following said amino acid selected from the group consisting of R1979G and C2422R.

In another embodiment said one or more adaptive mutations in HK6a/JFH1$_{[T1389C,A1590C]}$(HK6a-NS5A) is at least one of the replacements of the first said amino acid of SEQ ID NO 137 by the following said amino acid selected from the group consisting of 12274N.

Titer

To determine the efficiency of the developed system, HCV RNA titers are determined in IU/ml (international units/ml) with Taq-Man Real-Time-PCR and infectious titers are determined with a focus-forming units (FFU) method: in this method, infectivity titers are determined by infection of cell culture replicates with serial dilutions of virus containing supernatants and, following immuno-stainings for HCV antigens, counting of HCV-antigen positive cell foci. Alternatively the infectious titers are determined as 50% tissue culture infectious dose. This titer shows the dilution of the examined viral stock, at which 50% of the replicate cell cultures used in the essay become infected and is given in TCID$_{50}$/ml.

HCV RNA titers and infectivity titers can be determined extracellularly, in cell culture supernatant (given as IU and TCID$_{50}$ or FFU per ml, respectively) or intracellularly, in lysates of pelleted cells (given as IU and TCID$_{50}$ or FFU related to a the given cell number, which was lysed).

One embodiment of the present invention relates to a nucleic acid molecule of the present invention, wherein said molecule is capable of generating a HCV RNA titer of $10^4$ IU/ml or above following transfection and/or subsequent viral passage, such as a titer of at least $10^5$ IU/mL, such as a titer of at least $10^6$ IU/mL, such as a titer of at least $10^7$ IU/mL, such as a titer of at least $10^8$ IU/mL, such as a titer of at least $10^9$ IU/mL, such as a titer of at least $10^{10}$ IU/mL, such as a titer of at least $10^{11}$ IU/mL, or such as a titer of at least $10^{12}$ IU/mL.

In another embodiment, the present invention relates to a nucleic acid molecule according to the invention, wherein said molecule is capable of generating a HCV infectivity titer of at least $10^2$ FFU/ml or above following transfection and/or subsequent viral passage, such as a titer of at least $10^3$ FFU/ml, such as a titer of at least $10^4$ FFU/ml, such as a titer of at least $10^5$ FFU/ml, such as a titer of at least $10^6$ FFU/ml, such as a titer of at least $10^7$ FFU/ml, such as a titer of at least $10^8$ FFU/ml, such as a titer of at least $10^9$ FFU/ml or such as a titer of at least $10^{10}$ FFU/ml.

It is of course evident to the skilled addressee that the titers described here are obtained using the assay described in this text. Any similar or equivalent titer determined by any method is thus evidently within the scope of the present invention.

Composition

One embodiment of the present invention relates to a composition comprising a nucleic acid molecule according to the invention suspended in a suitable amount of a pharmaceutical acceptable diluent or excipient.

In another embodiment, this invention provides for compositions comprising an isolated nucleic acid, vector or cell of this invention, or an isolated nucleic acid obtained via the methods of this invention.

In one embodiment, the term "composition" refers to any such composition suitable for administration to a subject, and such compositions may comprise a pharmaceutically acceptable carrier or diluent, for any of the indications or modes of administration as described. The active materials in the compositions of this invention can be administered by any appropriate route, for example, orally, parenterally, intravenously, intradermally, subcutaneously, or topically, in liquid or solid form.

It is to be understood that any applicable drug delivery system may be used with the compositions and/or agents/vectors/cells/nucleic acids of this invention, for administration to a subject, and is to be considered as part of this invention.

The compositions of the invention can be administered as conventional HCV therapeutics. The compositions of the invention may include more than one active ingredient which interrupts or otherwise alters groove formation, or occupancy by RNA or other cellular host factors, in one embodiment, or replicase components, in another embodiment, or zinc incorporation, in another embodiment.

The precise formulations and modes of administration of the compositions of the invention will depend on the nature of the anti-HCV agent, the condition of the subject, and the judgment of the practitioner. Design of such administration and formulation is routine optimization generally carried out without difficulty by the practitioner.

It is to be understood that any of the methods of this invention, whereby a nucleic acid, vector or cell of this invention is used, may also employ a composition comprising the same as herein described, and is to be considered as part of this invention.

"Pharmaceutically acceptable" refers to molecular entities and compositions that are physiologically tolerable and do not typically produce an allergic or similar untoward reaction, such as gastric upset, dizziness and the like, when administered to a human. Preferably, as used herein, the term "pharmaceutically acceptable" means approved by a regulatory agency of the Federal or a state government or listed in the U.S. Pharmacopoeia or other generally recognized pharmacopoeia for use in animals, and more particularly in humans.

The term "excipient" refers to a diluent, adjuvant, carrier, or vehicle with which the compound is administered. Such pharmaceutical carriers can be sterile liquids, such as water and oils, including those of petroleum, animal, vegetable or synthetic origin, such as peanut oil, soybean oil, mineral oil, sesame oil and the like. Water or aqueous solution saline solutions and aqueous dextrose and glycerol solutions are preferably employed as carriers, particularly for injectable solutions. Suitable pharmaceutical carriers are described in "Remington's Pharmaceutical Sciences" by E. W. Martin.

The term "adjuvant" refers to a compound or mixture that enhances the immune response to an antigen. An adjuvant can serve as a tissue depot that slowly releases the antigen and also as a lymphoid system activator that non-specifically enhances the immune response. Often, a primary challenge with an antigen alone, in the absence of an adjuvant, will fail to elicit a humoral or cellular immune response. Adjuvants include, but are not limited to, complete Freund's adjuvant, incomplete Freund's adjuvant, saponin, mineral gels such as aluminum hydroxide, surface active substances such as lysolecithin, pluronic polyols, polyanions, peptides, oil or hydrocarbon emulsions, keyhole limpet hemocyanins, dinitrophenol, and potentially useful human adjuvants such as BCG (bacille Calmette-Guerin) and Corynebacterium parvmm. Preferably, the adjuvant is pharmaceutically acceptable.

Cells

The nucleotides of the present invention may be used to provide a method for identifying additional cell lines that are permissive for infection with HCV, comprising contacting (e.g. transfecting) a cell line in tissue culture with an infectious amount of HCV RNA of the present invention, e.g., as produced from the plasmid clones, and detecting replication and formation and release of viral particles of HCV in cells of the cell line.

Naturally, the invention extends as well to a method for identifying an animal that is permissive for infection with HCV, comprising introducing an infectious amount of the HCV RNA, e.g., as produced by the plasmids, to the animal, and detecting replication and formation and release of viral particles of HCV in the animal. By providing infectious HCV, e.g. comprising a dominant selectable marker, the invention further provides a method for selecting for HCV with further adaptive mutations that permit higher levels of HCV replication in a permissive cell line or animal comprising contacting (e.g. transfecting) a cell line in culture, or introducing into an animal, an infectious amount of the HCV RNA, and detecting progressively increasing levels of HCV RNA and infectious HCV viral particles in the cell line or the animal.

In a specific embodiment, the adaptive mutation permits modification of HCV tropism. An immediate implication of this aspect of the invention is creation of new valid cell culture and animal models for HCV infection.

The permissive cell lines or animals that are identified using the nucleic acids of the invention are very useful, inter alia, for studying the natural history of HCV infection, isolating functional components of HCV, and for sensitive, fast diagnostic applications, in addition to producing authentic HCV virus or components thereof.

Because the HCV DNA, e.g., plasmid vectors, of the invention encode HCV components, expression of such vectors in a host cell line transfected, transformed, or transduced with the HCV DNA can be effected.

For example, a baculovirus or plant expression system can be used to express HCV virus particles or components thereof. Thus, a host cell line may be selected from the group consisting of a bacterial cell, a yeast cell, a plant cell, an insect cell, and a mammalian cell.

In one embodiment, the cell is a hepatocyte, or in another embodiment, the cell is the Huh-7 hepatoma cell line or a derived cell line such as Huh7.5, Huh7.5.1 cell line.

In one embodiment, the cell, or in another embodiment, cell systems of this invention comprise primary cultures or other, also non hepatic cell lines. "Primary cultures" refers, in one embodiment, to a culture of cells that is directly derived from cells or tissues from an individual, as well as cells derived by passage from these cells, or immortalized cells.

In one embodiment, "cell line" refers to a population of cells capable of continuous or prolonged growth and division in vitro. The term "cell lines" also includes immortalized cells. Often, cell lines are clonal populations derived from a single progenitor cell. Such cell lines are also termed "cell clones". It is further known in the art that spontaneous or induced changes can occur in karyotype during storage or transfer of such clonal populations. Therefore, cells derived from the cell clones referred to may not be precisely identical to the ancestral cells or cultures. According to the present invention, such cell clones may be capable of supporting replication of a vector, virus, viral particle, etc., of this invention, without a significant decrease in their growth properties, and are to be considered as part of this invention.

It is to be understood that any cell of any organism that is susceptible to infection by or propagation of an HCV construct, virus or viral particle of this invention is to be considered as part of this invention, and may be used in any method of this invention, such as for screening or other assays, as described herein.

Thus in one embodiment the present invention relates to a method for producing a cell which replicates J6/JFH1 (H77-NS5A), J6/JFH1 (TN-NS5A), J6/JFH1 (J4-NS5A), J6/JFH1 (J6-NS5A), J6/JFH1 (S52-NS5A), J6/JFH1 (ED43-NS5A), J6/JFH1 (SA13-NS5A), J6/JFH1 (HK6a-NS5A) and J6/JFH1 (QC69-NS5A) RNA and produces a virus particle comprising introducing the said RNA according to the invention into a cell.

In another embodiment the invention relates to a method for producing a cell which replicates H77/JFH1$_{[T2700C,A4080T]}$(H77-NS5A), TN/JFH1$_{[C4562T]}$(TN-NS5A), J4/JFH1$_{[T2996C,A4827T]}$(J4-NS5A), S52/JFH1$_{[T2718G,A4550C]}$(S52-NS5A), ED43/JFH1$_{[A2819G,A3269T]}$ (ED43-NS5A), SA13/JFH1$_{[C3405G,A3696G]}$(SA13-NS5A) HK6a/JFH1$_{[T1389C,A1590C]}$(HK6a-NS5A) and QC69/JFH1$_{[T2985C]}$(QC69-NS5A) RNA and produces a virus particle comprising introducing the said RNA according to the invention into a cell.

Also, a method for in vitro producing a hepatitis C virus-infected cell comprising culturing the cell which produces virus particles of the present invention and infecting other cells with the produced virus particle in the culture.

Naturally, the invention extends to any cell obtainable by such methods, for example any in vitro cell line infected with HCV, wherein the HCV has a genomic RNA sequence as described herein such as a hepatitis C virus infected cell obtainable by any of the methods described.

In one embodiment, the cell line is a hepatocyte cell line such as Huh7 or derived cell lines e.g. Huh7.5 or Huh7.5.1.

In another embodiment the cell is Huh7.5.

In another embodiment the cell is any cell expressing the genes necessary for HCV infection and replication, such as but not limited to CD81, SR-BI, Claudin-1, -4, -6 or -9, occludin, and the low-density lipid receptor.

The invention further provides various methods for producing HCV virus particles, including by isolating HCV virus particles from the HCV-infected non-human animal of invention; culturing a cell line of the invention under conditions that permit HCV replication and virus particle formation; or culturing a host expression cell line transfected with HCV DNA under conditions that permit expression of HCV particle proteins; and isolating HCV particles or particle proteins from the cell culture.

In one embodiment the invention provides a method for producing a hepatitis C virus particle, comprising culturing the cell according to the above mentioned methods to allow the cell to produce the virus. Naturally the invention also pertains to a hepatitis C virus particle obtainable by this method.

Virus Particles

The present invention extends to an HCV virus particle comprising a replication-competent HCV genome RNA, or a replication-defective HCV genome RNA, corresponding to an HCV nucleic acid of the invention as well.

The production of authentic virus proteins (antigens) may be used for the development and/or evaluation of diagnostics. The cell culture system according to the invention also allows the expression of HCV antigens in cell cultures. In principle these antigens can be used as the basis for diagnostic detection methods.

The production of HCV viruses and virus-like particles, in particular for the development or production of therapeutics and vaccines as well as for diagnostic purposes is an embodiment of the present invention. Especially cell culture adapted complete HCV genomes, which could be produced by using the cell culture system according to the invention, are able to replicate and form viral particles in cell culture with high efficiency. These genomes have the complete functions of HCV and in consequence they are able to produce infectious viruses.

Thus in one embodiment the present invention relates to a method for producing a hepatitis C virus particle of the present invention or parts thereof, comprising culturing a cell or an animal to allow either to produce the virus.

In another embodiment the inventions provides a hepatitis C virus particle obtainable by the method described.

Because the invention provides, inter alia, infectious HCV RNA, the invention provides a method for infecting an animal with HCV which comprises administering an infectious dose of HCV RNA, such as the HCV RNA transcribed from the plasmids described above, to the animal. Naturally, the invention provides a non-human animal infected with HCV of the invention, which non-human animal can be prepared by the foregoing methods.

A further advantage of the present invention is that, by providing a complete functional HCV genome, authentic HCV viral particles or components thereof, which may be produced with native HCV proteins or RNA in a way that is not possible in subunit expression systems, can be prepared.

In addition, since each component of HCV of the invention is functional (thus yielding the authentic HCV), any specific HCV component is an authentic component, i.e., lacking any errors that may, at least in part, affect the clones of the prior art. Indeed, a further advantage of the invention is the ability to generate HCV virus particles or virus particle proteins that are structurally identical to or closely related to natural HCV virions or proteins. Thus, in a further embodiment, the invention provides a method for propagating HCV in vitro comprising culturing a cell line contacted with an infectious amount of HCV RNA of the invention, e.g., HCV RNA translated from the plasmids described above, under conditions that permit replication of the HCV RNA.

Further the viability of the developed viruses may be determined in vivo, either in SCID-uPA mice engrafted with human liver tissue or in chimpanzees as shown in Lindenbach et al. 2006.

In one embodiment, the method further comprises isolating infectious HCV. In another embodiment, the method further comprises freezing aliquots of said infectious HCV. According to this aspect of the invention, and in one embodiment, the HCV is infectious following thawing of said aliquots, and in another embodiment, the HCV is infectious following repeated freeze-thaw cycles of said aliquots.

Screening for anti-viral drugs and the determination of drug resistance It can be assumed that resistance to therapy occurs due to the high mutation rate of the HCV genome. This resistance, which is very important for the clinical approval of a substance, can be detected with the cell culture system according to the invention. Cell lines, in which the HCV-RNA construct or the HCV genome or subgenome replicates and produces infectious viral particles, are incubated with increasing concentrations of the relevant substance and the replication of the viral RNA is either determined by means of an introduced reporter gene or through the qualitative or quantitative detection of the viral nucleic acids or proteins. The release of viral particles is determined by measuring HCV RNA and infectivity titers in the cell culture supernatant. Resistance is given if no or a reduced inhibition of the replication and release of viral particles can be observed with the normal concentration of the active substance. The nucleotide and amino acid replacements responsible for the therapy resistance can be determined by recloning the HCV-RNA (for example by the means of RT-PCR) and sequence analysis. By cloning the relevant replacement(s) into the original construct its causality for the resistance to therapy can be proven.

The systems developed in this invention are ideal candidates for NS5A specific testing of therapeutics in general and therapeutics targeting viral replication, assembly and release.

In one embodiment the present invention relates to a method for screening an anti-hepatitis C virus substance, comprising
- a) culturing at least one selected from the group consisting of a cell according to the present invention, a hepatitis C virus infected cell according to the present invention and a hepatitis C virus particle obtainable by the present invention together with a hepatitis C virus permissive cell, and
- b) detecting the replicating RNA and/or the virus particles in the resulting culture.

Thus, one embodiment of the present invention relates to a method for screening an anti-hepatitis C virus substance, comprising
- a) culturing at least one selected from the group consisting of a cell according to the present invention, a hepatitis C virus infected cell according to the present invention and a hepatitis C virus particle obtainable by the present invention together with a hepatitis C virus permissive cell, and
- b) subjecting said virus or virus infected cell culture to the anti-hepatitis C virus substance, and
- c) detecting the replicating RNA and/or the virus particles in the resulting culture.

The invention further provides a method for assaying candidate antiviral agents for activity against HCV, comprising: a) exposing a cell containing the hepatitis C virus to the candidate antiviral agent; and b) measuring the presence or absence of hepatitis C virus replication in the cell of step (a).

The replication in step (b) may be measured by at least one of the following: negative strand RT-PCR, quantitative RT-PCR, Western blot, immunofluorescence, or infectivity in a susceptible cell culture or animal model.

Testing of Specific NS5A Inhibitors: Development of Putative Resistance Mutants.

In the search for novel specific HCV inhibitors, NS3, NS5A and NS5B are the main viral targets for most pharmaceutical companies. A number of NS5A inhibitors are currently being developed and Bristol-Meyers-Squibb has ongoing clinical studies of an antiviral compound targeting NS5A. Cell culture systems expressing NS5A of all major genotypes are highly relevant for preclinical testing of such compounds. For most antivirals occurrence of resistance mutants can be expected. This has been the case also for NS5A inhibitors in development. Testing of antiviral effects in cell culture on such mutants would be of primary interest for screening of resistance profiles of novel inhibitors. To demonstrate possibilities of testing resistance mutants in cell culture, the present inventors focused on the Y93H mutation in NS5A reported for the Bristol-Meyers-Squibb compound as well as several other compounds in development. Thus, Y93H mutants were generated (T93H for genotype 5a and 6a) for adapted recombinants of J6/JFH1 with NS5A of genotype 1a, 1b, 2a, 3a, 4a, 5a and 6a (SEQ ID NO 59-65, deduced amino acid SEQ ID NO 140-146; Example 19).

Testing of Antivirals: Genotype-Specific Effect of Treatment with Interferon-Alpha A number of studies have shown NS5A to be involved in the genotype-specific effects of interferon (IFN)-alpha treatment observed in patients. The developed NS5A systems are highly relevant for preclinical studies of this. In addition, a number of studies have indicated a role in treatment outcome of an interferon-sensitivity determining region (ISDR) in NS5A domain II of genotype 1b. To be able to study this, the present inventors additionally developed a J6/JFH1(1b-NS5A) 'interferon-sensitive type' ISDR mutant, J6/JFH1(J4-NS5A)$_{2952/3905, ISDRmut}$ (SEQ ID NO 10, deduced amino acid SEQ ID NO 91, Example 3 and Table 6). J6/JFH1 recombinants with genotype specific NS5A and the genotype 1b ISDR mutant were used to study the antiviral effect of IFN-alpha in cell culture (Example 20). The data shown in FIG. 15 indicate that certain isolates might be more responsive to IFN-alpha treatment, and that the ISDR region likewise might play a role.

Development of NS5A Systems that Allow for Insertion of Reporter Genes

For high-throughput screening of potential drug candidates, reporter-tagged virus recombinants are of high interest. The present inventors previously developed a reporter system for J6/JFH1 expressing an NS5A-EGFP (enhanced green fluorescent protein) fusion protein. The system is based on a 40 amino acid deletion in JFH1 NS5A domain II (A40-mutant; residues 250-293 on H77 reference NS5A amino acid sequence, residues 250-289 on JFH1) allowing for insertion of EGFP in NS5A domain III after position 418 on the H77 NS5A reference amino acid sequence. The system has been extended to adapted intergenotypic JFH1-based recombinants harbouring Core-NS2 sequence of genotypes 1-7 and is disclosed in a separate patent application. To develop NS5A reporter systems for NS5A of all genotypes, the present inventors here describe development of viable NS5A deletion mutants across all major genotypes (Example 23).

Development of Efficient Recombinants Expressing Epitope Tagged NS5A

An alternative to develop reporter based viral recombinants is insertion of epitope tags into the gene of interest. Often such tags are added either N-terminal or C-terminal ends not to disturb the fold and function of the protein. However, due to the necessary cleavage of the HCV polyprotein N-terminal or C-terminal tagging is not an option for HCV NS5A. We instead inserted the FLAG-tag (amino acid sequence DDDDK) at three different positions in J6/JFH1 NS5A (Example 24). Thus, we demonstrated the development of efficient NS5A epitope tag HCV recombinants.

Thus, in another embodiment the invention provides a nucleic acid molecule wherein J6/JFH1 (H77-NS5A), J6/JFH1 (TN-NS5A), J6/JFH1 (J4-NS5A), J6/JFH1 (J6-NS5A), J6/JFH1 (S52-NS5A), J6/JFH1 (ED43-NS5A), J6/JFH1 (SA13-NS5A), J6/JFH1 (HK6a-NS5A) and J6/JFH1 (QC69-NS5A) comprises one or more of the following mutations/modifications; The putative resistance mutation at amino acid position Y93H in NS5A (T93H for genotype 5a and 6a) encoded for by any possible nucleotide mutation as exemplified in SEQ ID NO 59-65 and deduced amino acid SEQ ID NO 140-146; ISDR 'sensitive-type' mutations of NS5A domain II as exemplified by SEQ ID NO 10 and the deduced amino acid SEQ ID NO 91; deletion mutants of NS5A domain II as exemplified for NS5A genotypes 1a and 2a in SEQ ID NO 66-68 and deduced amino acid SEQ ID NO 147-149; deletion mutants of NS5A domain III as exemplified by SEQ ID NO 69-78 and deduced amino acid SEQ ID NO 150-159; and viable NS5A epitope tag mutants as exemplified by SEQ ID NO 80-81 and deduced amino acid SEQ ID NO 161-162.

The above described mutations/modifications could similarly be introduced into the Core-NS2 recombinants with genotype specific NS5A, and a similar outcome be expected. Thus also mutations/modifications of H77/JFH1$_{[T2700C,A4080T]}$(H77-NS5A), TN/JFH1$_{[C4562T]}$(TN-NS5A), J4/JFH1$_{[T2996C,A4827T]}$(J4-NS5A), S52/JFH1$_{[T2718G,A4550C]}$(S52-NS5A), ED43/JFH1$_{[A2819G,A3269T]}$(ED43-NS5A), SA13/JFH1$_{[C3405G,A3696G]}$(SA13-NS5A), HK6a/JFH1$_{[T1389C,A1590C]}$(HK6a-NS5A) and QC69/JFH1$_{[T2985C]}$(QC69-NS5A) should be considered.

In another embodiment, the inhibition of HCV replication and/or infection and/or pathogenesis includes inhibition of downstream effects of HCV. In one embodiment, downstream effects include neoplastic disease, including, in one embodiment, the development of hepatocellular carcinoma.

In one embodiment, the invention provides a method of screening for anti-HCV therapeutics, the method comprising contacting a cell with an isolated nucleic acid molecule encoding an infectious recombinant HCV genome, comprising a chimeric HCV genome and contacting the cell with a candidate molecule, independently contacting the cell with a placebo and determining the effects of the candidate molecule on HCV infection, replication, or cell-to-cell spread, versus the effects of the placebo, wherein a decrease in the level of HCV infection, replication, or cell-to-cell spread indicates the candidate molecule is an anti-HCV therapeutic.

In one embodiment, the method may be conducted be in vitro or in vivo. In one embodiment, the cells as described may be in an animal model, or a human subject, entered in a clinical trial to evaluate the efficacy of a candidate molecule. In one embodiment, the molecule is labelled for easier detection, including radio-labelled, antibody labelled for fluorescently labelled molecules, which may be detected by any means well known to one skilled in the art.

In one embodiment, the candidate molecule is an antibody.

In one embodiment, the term "antibody" refers to intact molecules as well as functional fragments thereof, such as Fab, F(ab')2, and Fv. In one embodiment, the term "Fab" refers to a fragment, which contains a monovalent antigen-binding fragment of an antibody molecule, and in one embodiment, can be produced by digestion of whole antibody with the enzyme papain to yield an intact light chain and a portion of one heavy chain, or in another embodiment can be obtained by treating whole antibody with pepsin, followed by reduction, to yield an intact light chain and a portion of the heavy chain. In one embodiment, the term "F(ab')2", refers to the fragment of the antibody that can be obtained by treating whole antibody with the enzyme pepsin without subsequent reduction, F(ab')2 is a dimer of two Fab' fragments held together by two disulfide bonds. In another embodiment, the term "Fv" refers to a genetically engineered fragment containing the variable region of the light chain and the variable region of the heavy chain expressed as two chains, and in another embodiment, the term "single chain antibody" or "SCA" refers to a genetically engineered molecule containing the variable region of the light chain and the variable region of the heavy chain, linked by a suitable polypeptide linker as a genetically fused single chain molecule.

Methods of producing these fragments are known in the art.

In another embodiment, the candidate molecule is a small molecule. In one embodiment, the phrase "small molecule" refers to, inter-alia, synthetic organic structures typical of pharmaceuticals, peptides, nucleic acids, peptide nucleic acids, carbohydrates, lipids, and others, as will be appreciated by one skilled in the art. In another embodiment, small molecules, may refer to chemically synthesized peptidomimetics of the 6-mer to 9-mer peptides of the invention.

In another embodiment, the candidate molecule is a nucleic acid. Numerous nucleic acid molecules can be envisioned for use in such applications, including antisense, siRNA, ribozymes, etc., as will be appreciated by one skilled in the art.

It is to be understood that the candidate molecule identified and/or evaluated by the methods of this invention, may be any compound, including, inter-alia, a crystal, protein, peptide or nucleic acid, and may comprise an HCV viral product or derivative thereof, of a cellular product or derivative thereof. The candidate molecule in other embodiments may be isolated, generated synthetically, obtained via translation of sequences subjected to any mutagenesis technique, or obtained via protein evolution techniques, well known to those skilled in the art, each of which represents an embodiment of this invention, and may be used in the methods of this invention, as well.

In one embodiment, the compound identified in the screening methods as described, may be identified by computer modeling techniques, and others, as described herein. Verification of the activity of these compounds may be accomplished by the methods described herein, where, in one embodiment, the test compound demonstrably affects HCV infection, replication and/or pathogenesis in an assay, as described. In one embodiment, the assay is a cell-based assay, which, in one embodiment, makes use of primary isolates, or in another embodiment, cell lines, etc. In one embodiment, the cell is within a homogenate, or in another embodiment, a tissue slice, or in another embodiment, an organ culture. In one embodiment, the cell or tissue is hepatic in origin, or is a derivative thereof. In another embodiment, the cell is a commonly used mammalian cell line, which has been engineered to express key molecules known to be, or in another embodiment, thought to be involved in HCV infection, replication and/or pathogenesis.

In another embodiment, protein, or in another embodiment, peptide or in another embodiment, other inhibitors of the present invention cause inhibition of infection, replication, or pathogenesis of HCV in vitro or, in another embodiment, in vivo when introduced into a host cell containing the virus, and may exhibit, in another embodiment, an IC50 in the range of from about 0.0001 nM to 100 µM in an in vitro assay for at least one step in infection, replication, or pathogenesis of HCV, more preferably from about 0.0001 nM to 75 µM, more preferably from about 0.0001 nM to 50 µM, more preferably from about 0.0001 nM to 25 µM, more preferably from about 0.0001 nM to 10 µM, and even more preferably from about 0.0001 nM to 1 µM.

In another embodiment, the inhibitors of HCV infection, or in another embodiment, replication, or in another embodiment, pathogenesis, may be used, in another embodiment, in ex vivo scenarios, such as, for example, in routine treatment of blood products wherein a possibility of HCV infection exists, when serology shows a lack of HCV infection.

In another embodiment, the anti-HCV therapeutic compounds identified via any of the methods of the present invention can be further characterized using secondary screens in cell cultures and/or susceptible animal models. In one embodiment, a small animal model may be used, such as, for example, a tree shrew Tupaia belangeri chinensis. In another embodiment, an animal model may make use of a chimpanzee. Test animals may be treated with the candidate compounds that produced the strongest inhibitory effects in any of the assays/methods of this invention. In another embodiment, the animal models provide a platform for pharmacokinetic and toxicology studies.

Vaccines

The construct according to the invention by itself can also be used for various purposes in all its embodiments. This includes the construction of hepatitis C viruses or HCV-like particles and their production in cell cultures as described.

These HCV or HCV-like particles can be used in particular as vaccine. Thus, one embodiment of the present invention relates to a hepatitis C vaccine comprising a hepatitis C virus particle according to the invention or a part thereof.

In another embodiment, the nucleic acids, vectors, viruses, or viral particles may be further engineered to express a heterologous protein, which, in another embodiment, is mammalian or a derivative thereof, which is useful in combating HCV infection or disease progression. Such proteins may comprise cytokines, growth factors, tumor suppressors, or in one embodiment, may following infection, be expressed predominantly or exclusively on an infected cell surface. According to this aspect of the invention, and in one embodiment, such molecules may include costimulatory molecules, which may serve to enhance immune response to infected cells, or preneoplastic cells, or neoplastic cells, which may have become preneoplastic or neoplastic as a result of HCV infection. In one embodiment, the heterologous sequence encoded in the nucleic acids, vectors, viruses, or viral particles of this invention may be involved in enhanced uptake of a nucleic acids, vectors, viruses, or viral particles, and may specifically target receptors thought to mediate HCV infection.

Further, the present invention relates to a method for producing a hepatitis C virus vaccine comprising using a hepatitis C virus particle according to the invention as an antigen, and naturally any antibody against such hepatitis C virus particle.

The NS5A cell culture system developed of the present invention will be a valuable tool to address different research topics. It will allow the genotype specific study of NS5A using reverse genetics. The system developed in this study is ideal for the NS5A specific testing of new drugs, such as drugs interfering with replication as well as assembly and release. While the replicon system allows for studying replication only, this invention allows studies of the complete viral lifecycle.

Accordingly the NS5A cell culture systems allows individual patient targeting. This means that when a new potential therapeutic candidate is discovered it is possible to test this particular candidate or combination of candidates on any NS5A genotype or isolate. Knowing which specific genotype the candidate is functioning towards, it allows an individual treatment of each patient dependent on which specific genotype the patient is infected with. Furthermore these cell culture systems allow the development of antibodies and vaccines targeting individual patients.

The replication level of a virus can be determined, in other embodiments, using techniques known in the art, and in other embodiments, as exemplified herein. For example, the genome level can be determined using RT-PCR. To determine the level of a viral protein, one can use techniques including ELISA, immunoprecipitation, immunofluorescence, EIA, RIA, and Western blotting analysis. To determine the replication rate of a virus, one can use the method described in, e.g., Billaud et al., Virology 266 (2000) 180-188.

In one embodiment, the invention provides a method of identifying sequences in HCV associated with HCV pathogenicity, comprising contacting cells with an isolated nucleic acid molecule encoding an infectious recombinant HCV genome, comprising a chimeric HCV genome, contacting cells with an isolated nucleic acid molecule comprising at least one mutation of the chimeric HCV genome, independently culturing the cells and determining HCV infection, replication, or cell-to-cell spread, in cells contacted with the mutant, versus the chimeric HCV, whereby changes in HCV infection, replication, or cell-to-cell spread in cells contacted with the mutant virus shows the mutation is in an HCV sequence associated with HCV pathogenicity.

In one embodiment, the invention provides a method of identifying HCV variants with improved growth in cell culture, the method comprising contacting cells with an isolated nucleic acid molecule encoding an infectious recombinant HCV genome, comprising a chimeric HCV genome contacting cells with an isolated nucleic acid molecule comprising at least one mutation of the chimeric HCV genome, independently culturing the cells and determining HCV infection, replication, or cell-to-cell spread, in cells contacted with the chimeric HCV or the mutated virus, whereby enhanced HCV infection, replication, or cell-to-cell spread in cells contacted with the mutated virus shows that the HCV variant has improved growth in cell culture. In some embodiments, HCV variants are selected for enhanced replication, over a long course of time, in vitro culture systems. According to this aspect of the invention, and in some embodiments, cells contacted with the variants are characterized by reduced infection, as compared to cells contacted with the chimeric HCV.

Kit

In a related aspect, the invention also provides a test kit for HCV comprising HCV virus components, and a diagnostic test kit for HCV comprising components derived from an HCV virus as described herein.

Furthermore the invention also provide test kits, for screening for new HCV NS5A inhibitors, neutralizing and cross neutralizing antibodies, comprising HCV virus components.

Genera

Reference to any prior art in this specification is not, and should not be taken as, an acknowledgment or any form of suggestion that this prior art forms part of the common general knowledge in any country.

All patent and non-patent references cited in the present application, are hereby incorporated by reference in their entirety.

As will be apparent, preferred features and characteristics of one aspect of the invention may be applicable to other aspects of the invention. The invention may be embodied in other specific forms without departing from the spirit or essential characteristics thereof. The foregoing embodiments are therefore to be considered in all respects illustrative rather than limiting on the invention described herein. Scope of the invention is thus showed be the appended claims rather than by the foregoing description, and all changes that come within the meaning and range of equivalency of the claims are intended to be embraced by reference therein.

Throughout this specification the word "comprise", or variations such as "comprises" or "comprising", will be understood to imply the inclusion of a stated element, integer or step, or group of elements, integers or steps, but not the exclusion of any other element, integer or step, or group of elements, integers or steps.

In addition, singular reference does not exclude a plurality. Thus, references to "a", "an", "first", "second" etc. do not preclude a plurality.

The invention may be embodied in other specific forms without departing from the spirit or essential characteristics thereof. The foregoing embodiments are therefore to be considered in all respects illustrative rather than limiting on the invention described herein. Scope of the invention is thus showed be the appended claims rather than by the foregoing description, and all changes that come within the meaning and range of equivalency of the claims are intended to be embraced by reference therein.

It should be noted that embodiments and features described in the context of one of the aspects of the present invention also apply to the other aspects of the invention.

The invention will now be described in further details in the following non-limiting examples.

EXAMPLES

Example 1

Materials & Method

Construction of JFH1-Based Recombinants with NS5A of Genotypes 1-7

For construction of J6/JFH1 with genotype specific NS5A, the JFH1 NS5A sequence was replaced by the complete NS5A consensus sequence from genotypes 1-7 by standard fusion PCR (Pfu polymerase, Stratagene, La Jolla, Calif., USA) and cloning techniques.

NS5A was from isolate H77C (genotype 1a), HC-TN (1a), J4 (1b), 36 (2a), S52 (3a), ED43 (4a), SA13 (5a), HK6a (6a) or QC69 (7a). The NS5A consensus sequences of H77C, HC-TN, 34 and 36 were previously described (Yanagi et al. 1997; Yanagi et al. 1998; Yanagi et al. 1999; Sakai et al. 2007). NS5A consensus sequences of S52, ED43, SA13 and HK6a were obtained from chimpanzee infectious pools by RNA extraction (Highly Pure Viral Nucleic Acid Kit™, Roche, Mannheim, Del.), reverse-transcription (RT)-PCR (using Superscript III™, Invitrogen, Carlsbad, Calif., USA and Advantage 2 PCR Enzyme System™, Clontech, Mountain View, Calif.) cloning (TOPO-XL™ cloning kit, Invitrogen) and sequencing. cDNA consensus clones were constructed by standard cloning techniques. The nucleotide sequence of isolate QC69 is published (GenBank accession number: EF108306.1), and the NS5A sequence was synthesized (GenScript Inc., Piscataway, N.J., USA). Four positions in the QC69 NS5A sequence were not defined. At these positions, nucleotides that were found for most related sequences of other genotypes in the HCV Los Alamos database were chosen.

In addition, NS5A consensus sequences were inserted into the JFH1-based Core-NS2 genotype recombinant of the same genotype harboring the original identified adaptive mutations as previously described. Thus, H77C NS5A was inserted into H77C/JFH1$_{2700,4080}$, HC-TN NS5A into TN/JFH1$_{4562}$, J4 NS5A into J4/JFH1$_{2996,4827}$, S52 NS5A into S52/JFH1$_{2718,4550}$, ED43 NS5A into ED43/JFH1$_{2819,3269}$, SA13 NS5A into SA13/JFH1$_{3405,3696}$, HK6a NS5A into HK6a/JFH1$_{1389,1590}$ and QC69 NS5A into QC69/JFH1$_{2985}$. Generation of cDNA clones of these recombinants were done by standard fusion PCR (Pfu polymerase, Stratagene, La Jolla, Calif., USA) and cloning techniques.

Engineering of mutations, deletions and insertions into the described recombinant clones was done by standard mutagenesis fusion PCR (Pfu polymerase, Stratagene) and cloning techniques DNA stocks of final plasmids were prepared using QIAGEN HiSpeed™ Plasmid Maxi Kit. The complete HCV sequence of final plasmid preparations was confirmed.

Culturing, Transfection and Infection of Huh7.5 Cells.

Culturing of Huh7.5 cells was done as described by Gottwein et al. 2007. One day prior to transfection or infection, naïve Huh7.5 cells were plated at $4 \times 10^5$/well in 6-well plates. In vitro transcription was carried out for 2 hours with T7 RNA polymerase (Promega) on 5 μg plasmid linearized with XbaI and treated with Mung Bean Nuclease (New England Biolabs, Beverly, Mass., USA) to yield the exact HCV 3' end. For transfection, 2.5 μg of unpurified RNA transcripts were incubated with 5 μL Lipofectamine2000™ (Invitrogen) in 500 μL Opti-MEM (Invitrogen) for 20 min at room temperature. RNA-Lipofectamine2000™ transfection complexes were left on cells for 16-24 hours before washing. For infection, virus-containing supernatant was left on cells for 6-24 hours. Supernatants collected during experiments were sterile filtered and stored at −80° C.

Evaluation of Infected Cultures

Anti-Core immunostaining was done with mouse anti-HCV Core protein monoclonal antibody (B2) (Anogen Mississauga, Ontario, Canada) as primary antibody and Alexa Fluor 594 goat anti-mouse IgG (H+L) (Invitrogen) as secondary antibody. HCV RNA titers were determined by a TaqMan™ real-time PCR assay. Infectivity titers were determined as follows: $6 \times 10^3$ naïve Huh7.5 cells were plated per well in a poly-D-lysine coated 96-well plate (Nunc) one day before inoculation with three replicates of individual 10-fold dilutions of cell culture supernatants. Inocula were left on cells for 48 hours and cells were fixed using ice could methanol. After washing, blocking buffer (1% BSA, 0.2% skim milk) was added for 20 min and endogenous peroxidases were inhibited by application of $H_2O_2$ for 5 min. Primary antibody (anti-NS3, clone H26, Abcam, Cambridge, UK) diluted 1:1000 was left on cells for 3-4 days. Secondary antibody was ECL anti-mouse IgG HRP-linked whole antibody (GE Healthcare Amersham, Brondby, Denmark). Staining was developed using DAB substrate kit (DAKO, Glostrup, Denmark). The number of focus-forming units (FFU) per well were counted manually (dilutions with 5-100 FFU counted) or automatically. Automatic counting was performed on an ImmunoSpot Series 5 UV Analyzer™ (CTL Europe GmbH, Aalen, Baden-Württemberg, DE) with customized software. From FFU counts in experimental wells, the mean of spot counts of negative control wells was subtracted (typically around 5 spots). Final count numbers were comparable to manual counting, and counts of 20-200 FFU were in the linear range of dilution standard curves.

Treatment of Infected Cultures $5 \times 10^3$ naïve Huh7.5 cells were plated per well in a poly-D-lysine coated 96-well plate (Nunc, Roskilde, D K) one day before infection with different recombinant viruses. Infectious doses were chosen to aim at 400-1000 single infected cells in non-treated wells at the end of the experiment. J6/JFH1 was included with two infectious doses (high and low) to control for impact of dose variability. The infectious dose of other recombinants was in the range between. Cultures were treated with IFN-alpha 2b (Schering-Plough, Kenilworth, N.J., USA) at the given dose one and two days after infection. On day three cells were fixed and immunostained for NS3 expression as described above. In parallel, cell viability was monitored with CellTiter™ 96 AQueous One Solution Cell Proliferation Assay (Promega, Madison, Wis. USA). The number of single infected cells was determined by automated counting of individual wells as described above.

Direct Sequencing of the Complete ORF of Recovered Viruses.

RNA was extracted from cell culture supernatant using (Highly Pure Viral Nucleic Acid Kit™, Roche, Mannheim, Del.). RT-PCR was done using SuperScriptIII™ (Invitrogen, Carlsbad, Calif., USA). In 1$^{st}$ round PCR the Advantage 2 PCR Enzyme System was used. Cycle parameters were 35 s at 99° C., 30 s at 67° C. and 10 min (cycle 1-5), 11 min (cycle 6-15), 12 min (cycle 16-25) or 13 min (cycle 26-35) at 68° C. 12~1 kb products were synthesized in overlapping nested PCRs covering the entire ORF using primer pairs as previously described. Primer pairs 8, 9 and 10 were modified to the genotype specific NS5A sequence (Table 20, SEQ ID NO 163-192). Cycle parameters were 35 s at 99° C. followed by 35 cycles with 35 s at 99° C., 30 s at 67° C. and 6 min at 68° C.

Sequencing, Sequence Analysis and Databases.

All sequence reactions were performed at Macrogen Inc., Seoul, South Korea. Sequence analysis was performed with Sequencher™ (Gene Codes Corporation) Vector NTI 11 (Invitrogen) and BioEdit™ (Tom Hall, Ibis Therapeutics). HCV sequences were retrieved from the European HCV database (euHCVdb; at the http: internet location //euhcvdb.ibcp.fr/euHCVdb/) and the Los Alamos HCV sequence database (LANL; at the http: Internet location //hcv.lanl.gov/content/hcv-db/index).

Example 2

Development of J6/JFH1-Based Cell Culture Systems for NS5A Genotypes 1-7

To generate genotype specific HCV cell culture systems for the NS5A gene, the complete NS5A sequence of J6/JFH1 was replaced by reference isolates of genotype 1a (H77C or HC-TN), 1b (J4), 2a (J6), 3a (S52), 4a (ED43), 5a (SA13), 6a (HK6a) or 7a (QC69) (SEQ ID NO 1, 3, 5, 11, 13, 24, 33, 40 and 43, deduced amino acid SEQ ID NO 82, 84, 86, 92, 94, 105, 114, 121 and 124). RNA transcripts were transfected into Huh7.5 hepatoma cells and culture infection was followed by immunostaining for Core expression and by titration of infectivity released to supernatant. Spread of infection with J6/JFH1 with NS5A from H77, TN, 36, S52 and QC69 was only slightly delayed compared to J6/JFH1, and relatively high viral titers were produced after transfection (FIGS. 1, 3, 4, 8). J6/JFH1 with NS5A from 34, ED43, SA13 and HK6a spread in culture on day 13, 10, 29 and 12 (In two additional transfections, J6/JFH1(HK6a-NS5A) spread to the majority of cells on day 6 and 25, respectively), respectively. The late spread in culture was reflected by low infectivity in supernatant after transfection (FIGS. 2, 6, 7, 8). As the only case, no replication was observed on day 1 after transfection for J6/JFH1(SA13-NS5A). After infection of the whole culture, virus was passaged to naïve cells (Table 1a). The complete open reading frame (ORF) was sequenced from 1st passage cultures. Except for genotypes 1a and 7a, putative adaptive mutations were identified (Table 4-11). Mutations were tested singly and in combination in reverse genetic studies.

Example 3

Development of Efficient J6/JFH1(1a-NS5A) System

The original constructs of J6/JFH1(H77-NS5A) and J6/JFH1(TN-NS5A) produced relatively high infectivity titers immediately after transfection and no additional mutations were identified after passage to naïve cells. The same was observed in repeated transfections with these constructs. For J6/JFH1(H77-NS5A) maximum infectivity titers in transfection and 1st passage were $10^{3.2}$ and $10^{4.0}$ focus-forming units (FFU)/mL, respectively. J6/JFH1(TN-NS5A) produced infectivity titers in transfection and 1st passage of $10^{3.5}$ and $10^{4.1}$ FFU/mL, respectively. Maximum RNA titers were $10^{7.2}$ and $10^{6.9}$ IU/mL for H77 and TN, respectively. Thus, efficient systems for H77 and TN NS5A had been developed (FIG. 1, Table 1a and Table 2). Since the p7 mutation T2667C was observed for several recombinants this change was introduced into J6/JFH1(H77-NS5A) and J6/JFH1(TN-NS5A) to investigate whether even higher infectivity titers could be achieved (SEQ ID NO 2 and 4, deduced amino acid SEQ ID NO 83 and 85). However, titers after transfection were not affected by the mutation, and T2667C mutants acquired additional mutations when sequenced after passage to naïve cells (FIG. 1, Table 4 and Table 5).

Example 4

Development of Efficient J6/JFH1(1b-NS5A) and J6/JFH1(1b-NS5A) ISDR Mutant System Two mutations were identified for J6/JFH1(J4-NS5A), G2952A in NS2 and T3905A in NS3 after transfections and passage to naïve cells (Table 6). These were tested singly and in combination. In addition the importance of the T2667C mutation in p7 observed for several recombinants was tested for J6/JFH1(J4-NS5A) (SEQ ID NO 6-9, deduced amino acid SEQ ID NO 87-90). Recombinants with the T3905A mutation produced efficient viral titers immediately after transfection (FIG. 2*a*). Both genomes were stable when sequenced after passage to naïve cells (Table 1a and Table 6) (in one of two experiments, J6/JFH1(J4-NS5A)$_{2952/3905}$ acquired additional mutations (Table 6). J6/JFH1(J4-NS5A)$_{2952/3905}$ produced the highest infectivity titers in transfection and 1st passage: $10^{4.2}$ and $10^{3.9}$ FFU/mL, respectively. RNA titers of $10^{7.2}$ international units (IU)/mL were produced in 1st passage (Table 1a and Table 2)

HCV genotype 1 infection is associated with a hard-to-treat phenotype in patients. However, the sequence of the interferon-sensitivity determining region (ISDR) in NS5A domain II was previously suggested to determine the treatment-outcome for patients of genotype 1b. To be able to study the importance of this region in response to interferon treatment in vitro, we developed the putative interferon-sensitive type J6/JFH1(J4-NS5A)$_{2952/3905,ISDRmut}$ recombinant harbouring five amino acid substitutions in the ISDR (Table 6, (SEQ ID NO 10, deduced amino acid SEQ ID NO 91)). After transfection into Huh7.5 cells efficient viral titers were produced (FIG. 2*b*, Table 1a and Table 2), and no additional mutations were identified after sequencing of virus from 1st passage cultures (Table 6).

Example 5

Development of Efficient J6/JFH1(2a(J6)-NS5A) Systems

T2667C in p7 was identified as the only mutation occurring for J6/JFH1(J6-NS5A) after transfection and passage to naïve cells (Table 7). Transfection of the J6/JFH1(J6-NS5A) recombinant with this mutation (SEQ ID NO 12, deduced amino acid SEQ ID NO 93) resulted in an increase of infectivity titers to a level comparable to J6/JFH1 (FIG. 3). Maximum infectivity titers in transfection and 1st passage were $10^{4.5}$ and $10^{4.3}$ FFU/mL, respectively. RNA titers of $10^{7.2}$ IU/mL were produced in 1st passage (Table 2). When sequenced after passage to naïve cells the genome was stable except for a position in NS5A showing a mixture of input and mutated sequence (Table 7).

Example 6

Development of Efficient J6/JFH1(3a-NS5A) Systems

Figure 4:
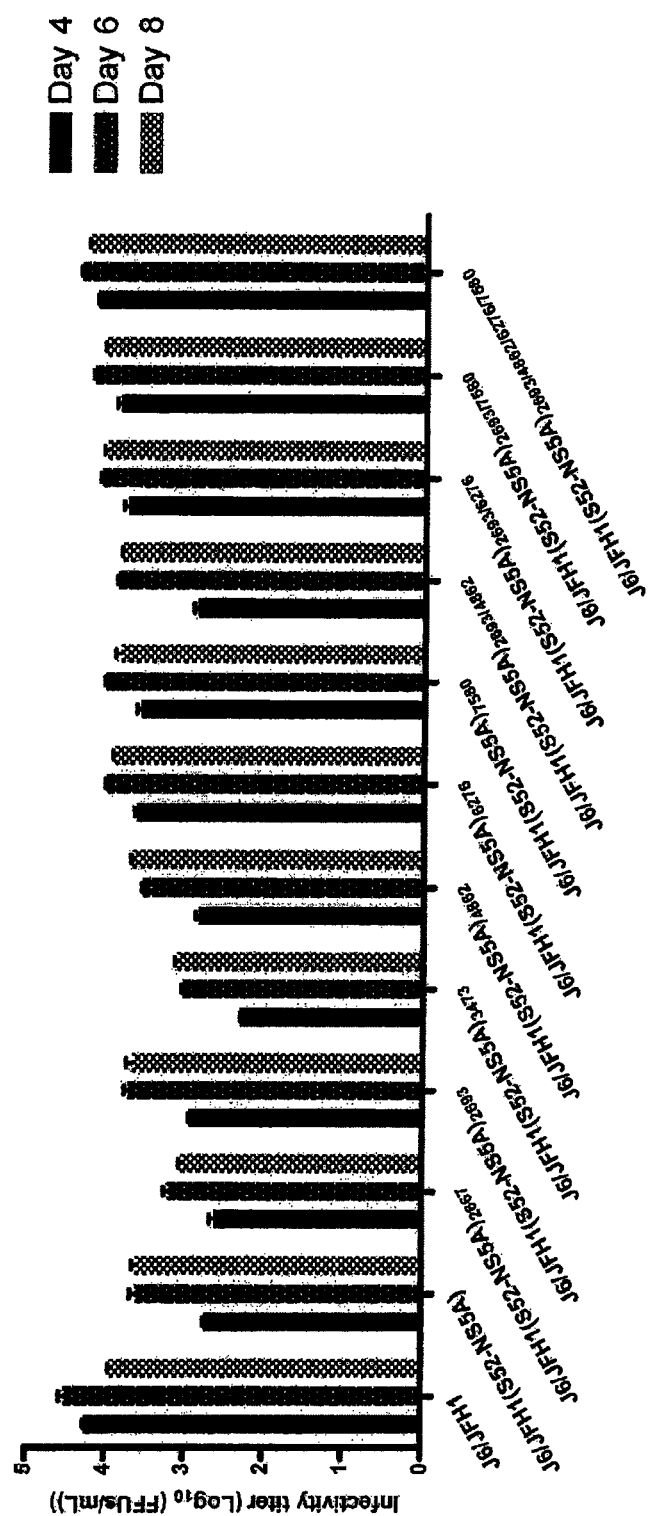

Sequencing of J6/JFH1(S52-NS5A) after transfection and passage revealed five coding mutations in p7, NS3 and NS5A (Table 8). These were tested singly and in selected combinations. In addition the T2667C mutation in p7 was tested for J6/JFH1(S52-NS5A) (SEQ ID NO 14-23, deduced amino acid SEQ ID NO 95-104). J6/JFH1(S52-NS5A) with A6276G, C2693G/A6276G and C2693G/A4862C/A6276G/T7580C exhibited the most efficient spread and infection kinetics after transfection (FIG. 4). Thus, these were passaged to naïve cells and the complete ORF was sequenced. J6/JFH1 (S52-NS5A)$_{2693/4862/6276/7580}$ achieved the highest infectivity titers in transfection and $1^{st}$ passage: $10^{4.2}$ and $10^{4.1}$ FFU/mL, respectively. RNA titers of $10^{7.5}$ IU/mL were produced in $1^{st}$ passage (Table 2). No additional mutations were identified for the three recombinants (Table 8).

Example 7

Development of Efficient J6/JFH1(4a-NS5A) Systems

Figure 5A:
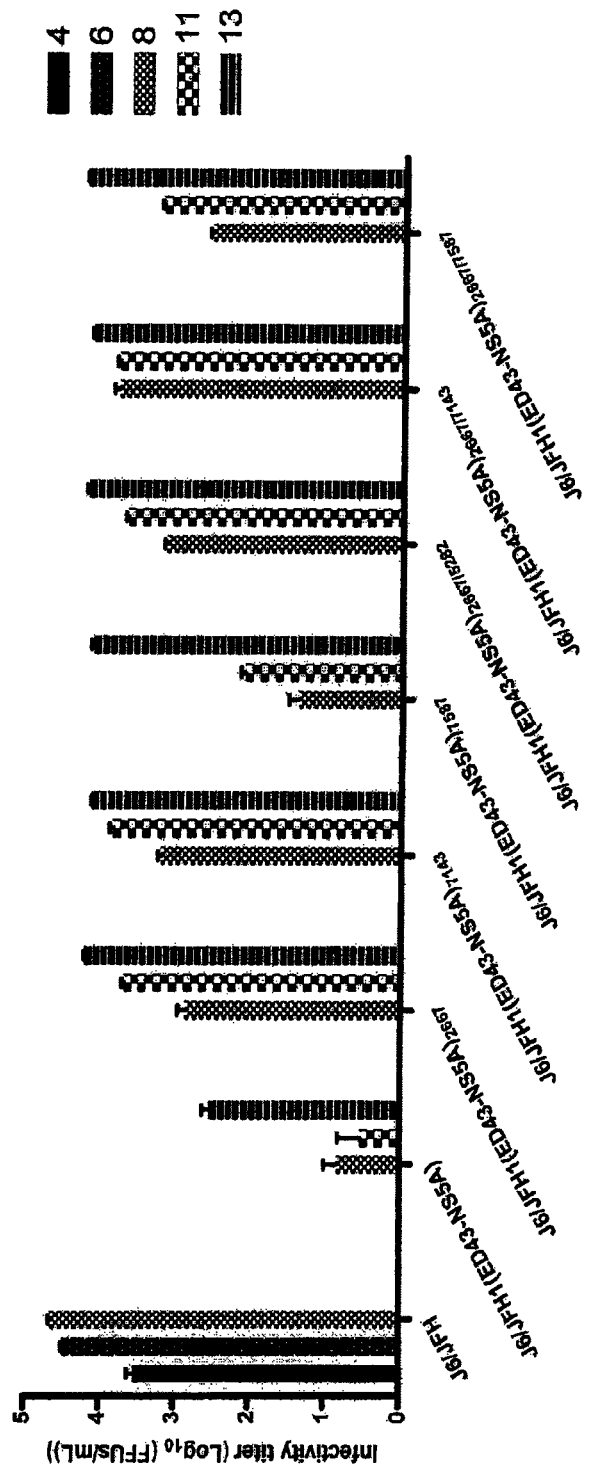
Figure 5B:
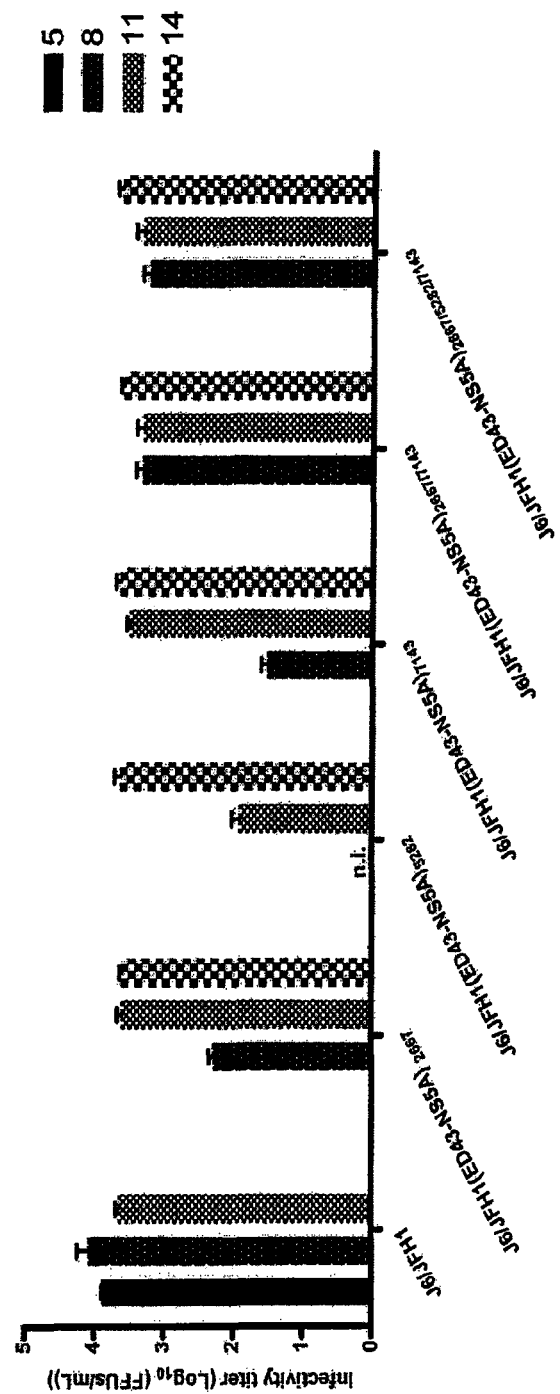

After two independent transfection and passage experiments of J6/JFH1(ED43-NS5A), a number of putative adaptive mutations were identified primarily in p7, NS2, NS3 and NS5A (Table 9). T2667C in p7 was found in both experiments. We included T2667C, T5282C, A7143G and A7587G singly and in selected combinations in reverse genetic studies (SEQ ID NO 25-32, deduced amino acid SEQ ID NO 106-113). J6/JFH1(ED43-NS5A) with T2667C, A7143G, T2667C/T5282C, T2667C/A7143G and T2667C/T5282C/A7143G exhibited the most efficient spread and infection kinetics after transfection (FIGS. 5a and 5b). Thus, these were passaged to naïve cells and the complete ORF was sequenced. Maximum infectivity titers were achieved for J6/JFH1(ED43-NS5A) with A7143G, T2667C/T5282C, T2667C/A7143G or T2667C/T5282C/A7143G. In transfection and $1^{st}$ passage peak titers obtained were $10^{3.6-4.1}$ and $10^{4.2-4.3}$ FFU/mL, respectively. RNA titers of $10^{7.2-7.6}$ IU/mL were produced in $1^{st}$ passage (Table 1a and Table 2). J6/JFH1 (ED43-NS5A)$_{2667/5282/7143}$ did not acquire addition mutations after sequencing of virus from $1^{st}$ passage (Table 9) (In one of two experiments A7590G in NS5A was observed).

Example 8

Development of Efficient J6/JFH1(5a-NS5A) Systems

Figure 6:
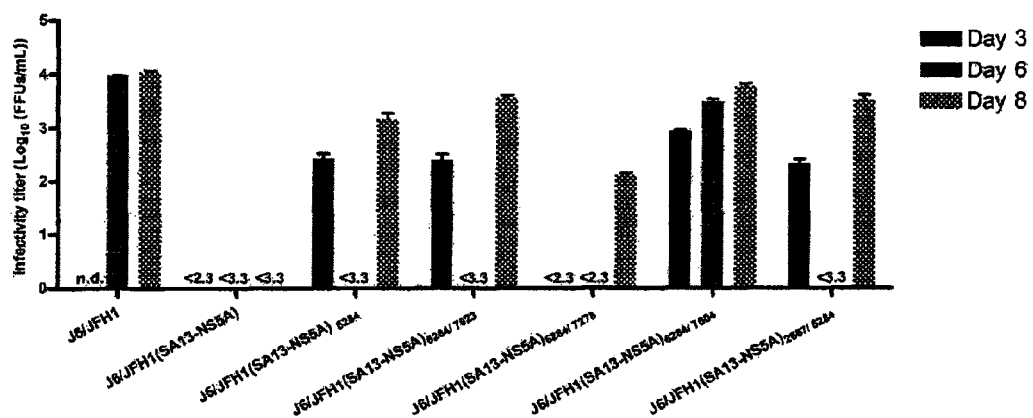

A number of putative adaptive mutations were identified for J6/JFH1(SA13-NS5A) in E2 and NS5A after transfection and passage (Table 10). Along with T2667C, we tested A6284G, C7023T, C7278T and A7604G singly and in selected combinations (SEQ ID NO 35-39, deduced amino acid SEQ ID NO 116-120). J6/JFH1(SA13-NS5A) with A6284G, A6284G/A7604G and T2667C/A6284G exhibited the most efficient spread and infection kinetics after transfection (FIG. 6). Thus, these were passaged to naïve cells and the complete ORF was sequenced. J6/JFH1(SA13-NS5A)$_{6284/7604}$ achieved the highest infectivity titers of $10^{3.8}$ FFU/mL in transfection and $1^{st}$ passage (Table 2). J6/JFH1 (SA13-NS5A) with A6284G and A6284G/A7604G genomes were stable when sequencing $1^{st}$ passage virus (Table 10).

Example 9

Development of Efficient J6/JFH1(6a-NS5A) Systems

Figure 7A:
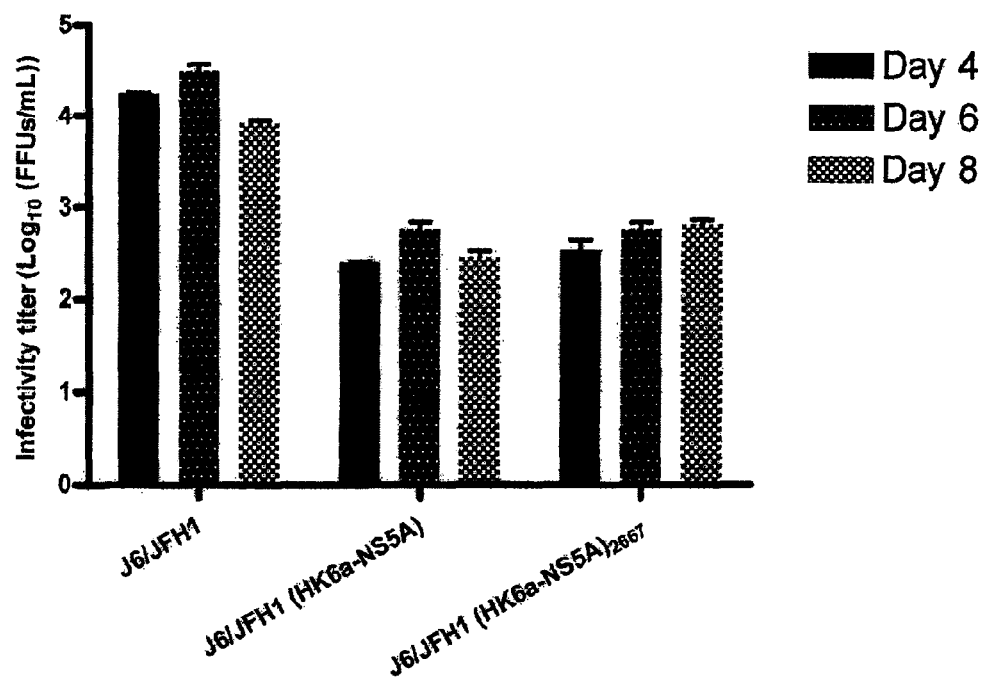
Figure 7B:
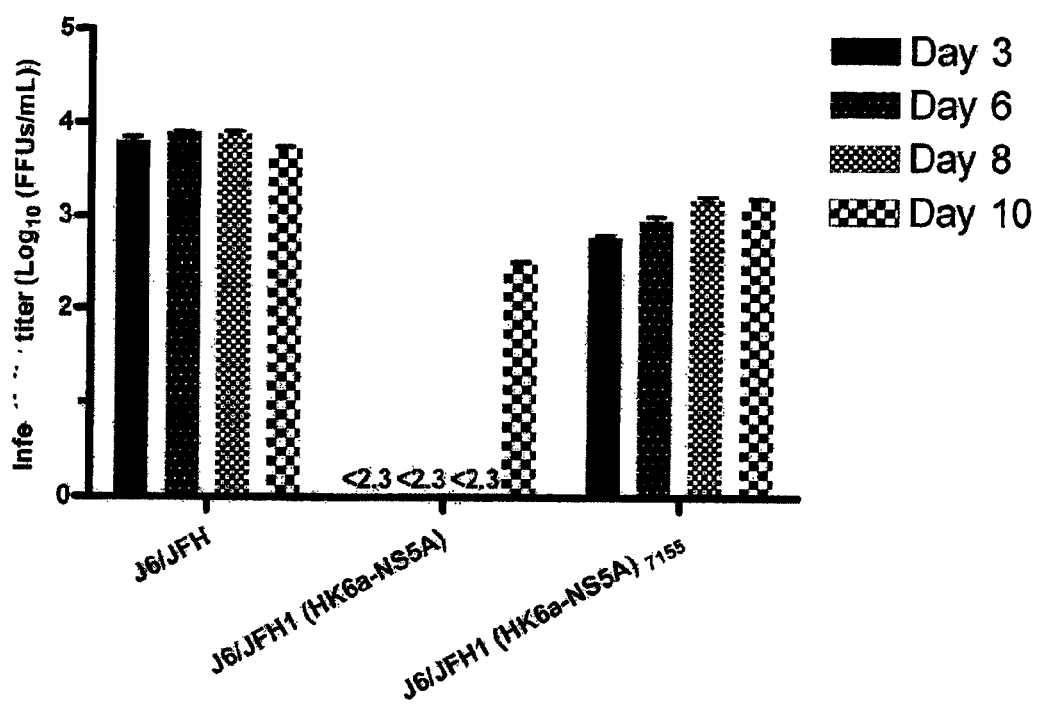

Sequencing of the entire ORF of J6/JFH1(HK6a-NS5A) after transfection and passage revealed three mutations in NS4B, NS5A and NS5B (Table 11). Based on previous experiments for other genotypes showing NS5A but not NS4B and NS5B as a region for adaptive mutations we selected the T7155A mutation for reverse genetic studies. In addition the T2667C mutations were analyzed (SEQ ID NO 41-42, deduced amino acid SEQ ID NO 122-123). After transfection only J6/JFH1(HK6a-NS5A)$_{7155}$ produced relatively high infectivity titers (FIGS. 7a and 7b). Maximum infectivity titers in transfection were $10^{3.2}$ FFU/mL and in $1^{st}$ passage $10^{4.1}$ FFU/mL (Table 2).

Example 10

Development of Efficient J6/JFH1(7a-NS5A) Systems

Figure 8:
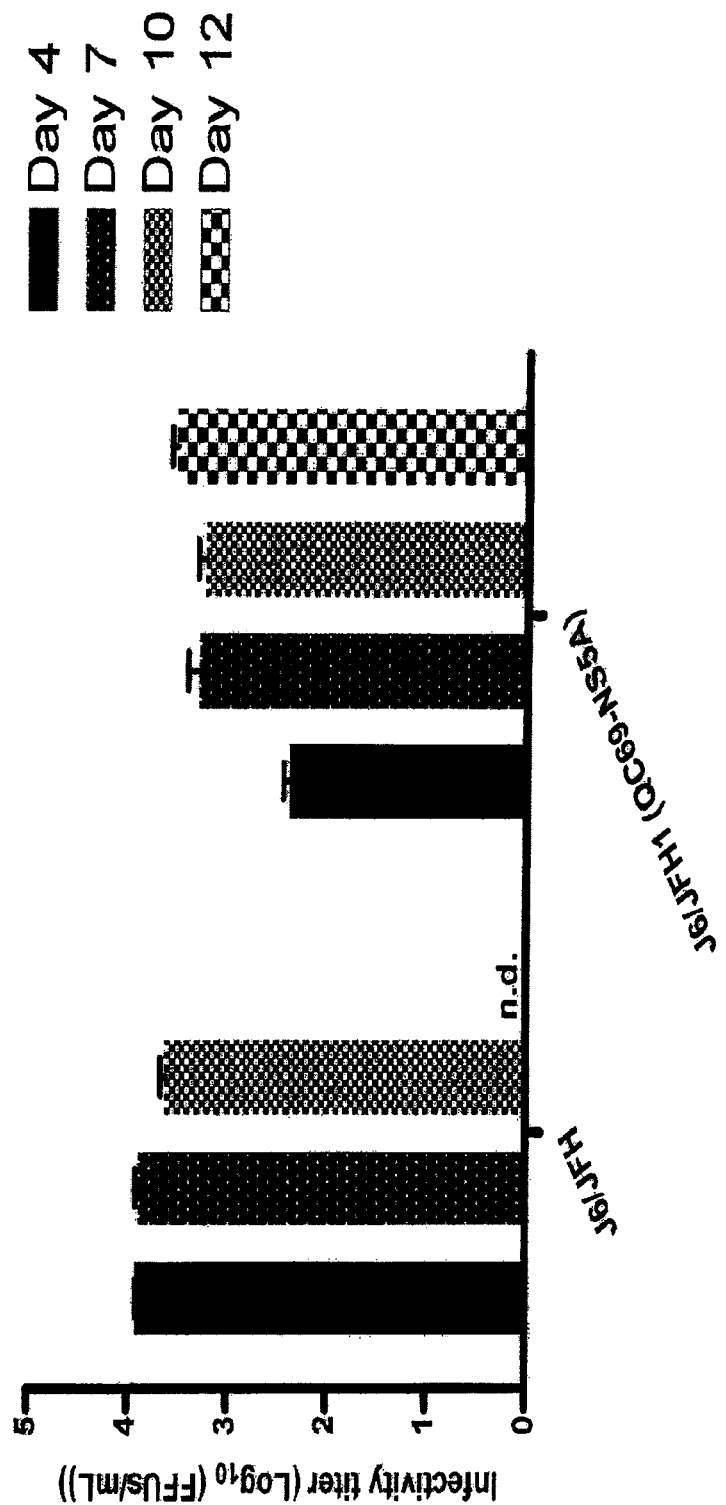
Figure 9:
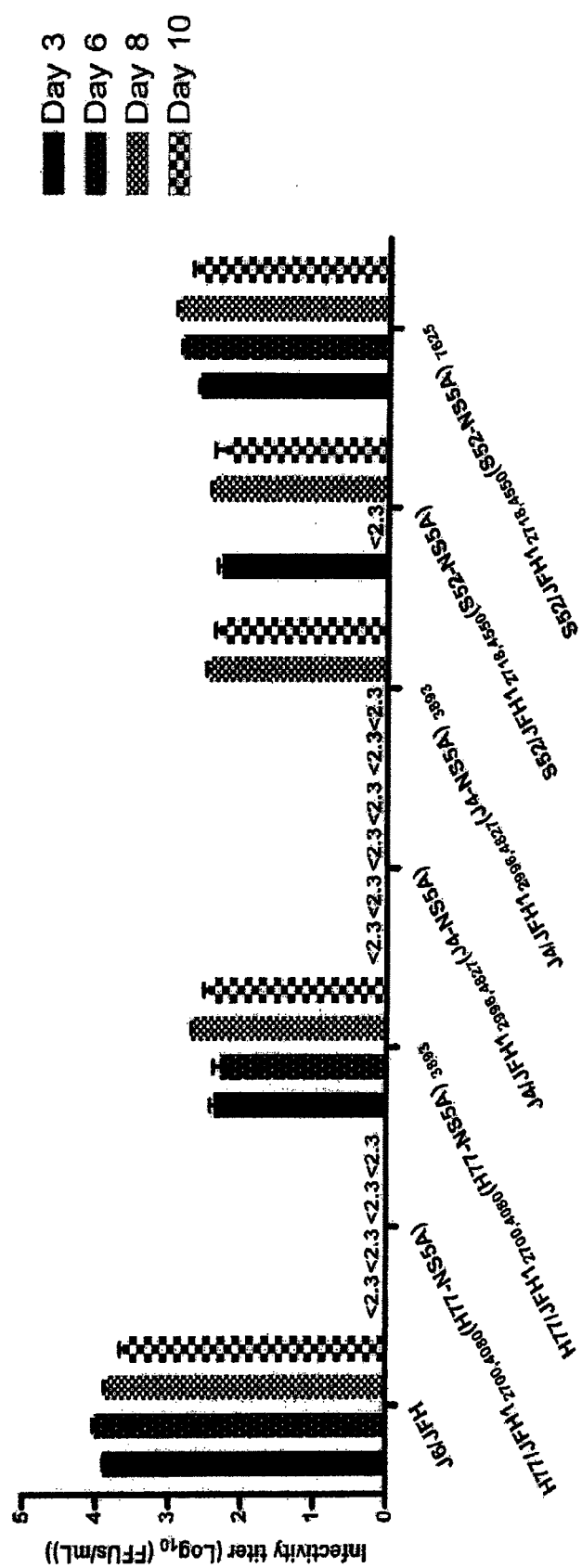
Figure 10:
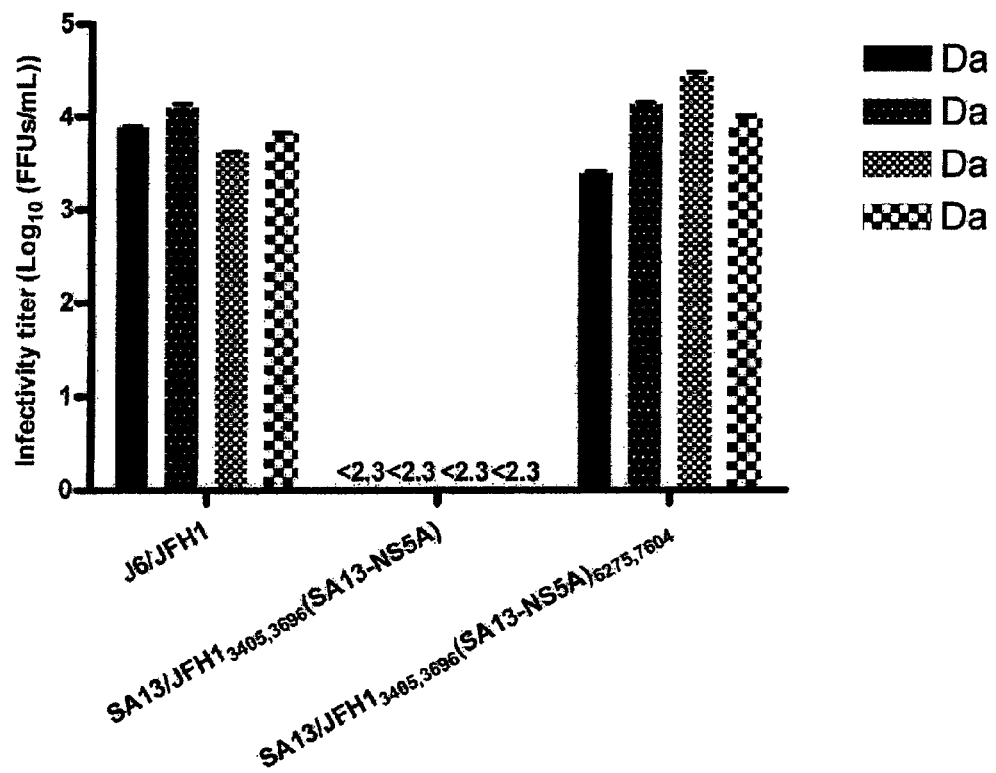
Figure 11:
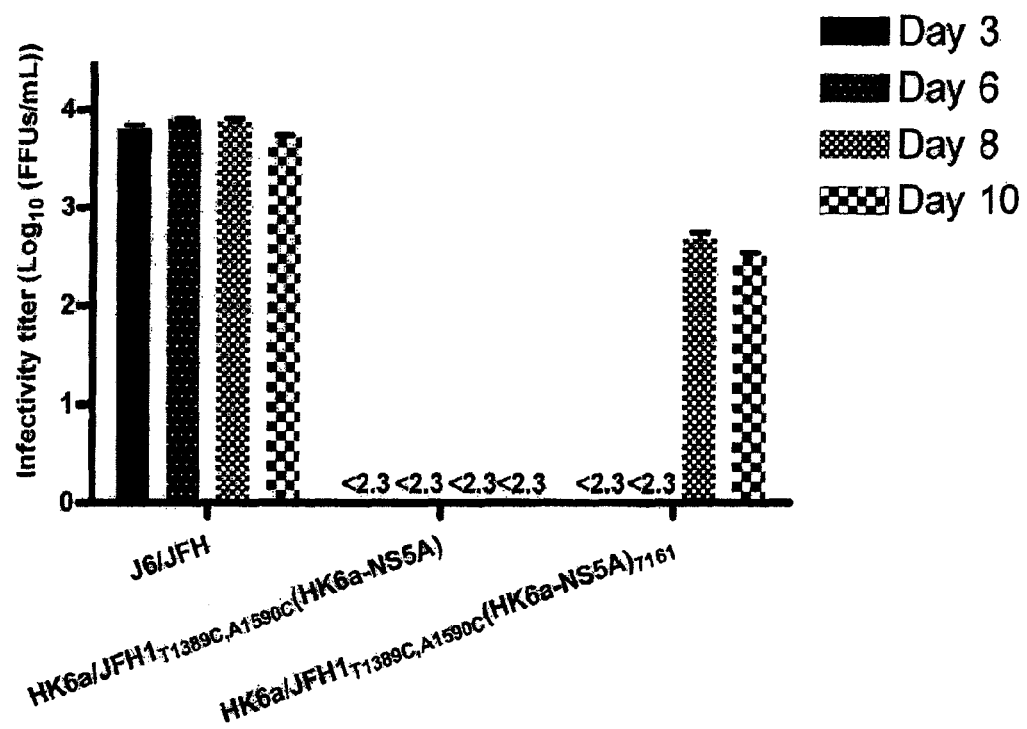
Figure 12:
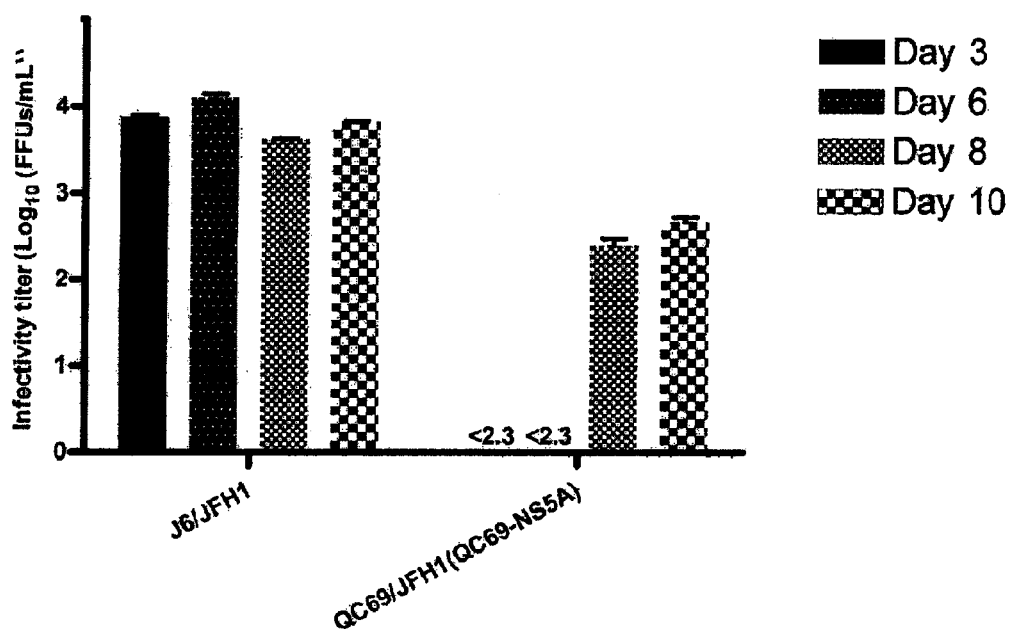

The original construct of J6/JFH1(QC69-NS5A) produced relatively high infectivity titers immediately after transfection (FIG. 8 and Table 1a), and no additional mutations were identified after passage to naïve cells. Maximum infectivity titers in transfection were $10^{3.3}$ FFU/mL and in $1^{st}$ passage 10" FFU/mL. RNA titers of $10^{7.2}$ IU/mL were obtained (Table 2). Thus, efficient NS5A systems for QC69 had been developed (SEQ ID NO 43, deduced amino acid SEQ ID NO 124).

Example 11

Development of Recombinants with Genotype-Specific Core-NS2 and NS5a Sequences We previously developed JFH-1 based intergenotypic recombinants with Core-NS2 of all seven major genotypes. To extend the genotype specific region of the available HCV cell culture systems we developed another panel of recombinants by inserting the NS5A gene of genotype 1a (H77C or HC-TN), 1b (J4), 3a (S52), 4a (ED43), 5a (SA13), 6a (HK6a) or 7a (QC69) into the Core-NS2 recombinant of the same genotype harbouring the original adaptive mutations. The resulting constructs have genotype specific Core, E1, E2, p7, NS2 and NS5A sequences, while the untranslated regions and the NS3, NS4A, NS4B and NS5B genes are from JFH1 (SEQ ID NO 44, 46, 47, 49, 52, 54, 56 and 58, deduced amino acid SEQ ID NO 125, 127. 128. 130, 133, 135, 137 and 139).

After transfection of RNA transcripts into Huh7.5 cells, the novel recombinants spread to the majority of culture after an eclipse phase of variable length. J6/JFH1 with NS5A from H77, TN, J4, S52, ED43, SA13, HK6a and QC69 spread in culture after 36, 22-36, 22-43, 6-10, 22-27, 18, 6-12 and 6 days, respectively (Intervals are given for recombinants transfected and followed multiple times). The late spread in culture observed for some recombinants was reflected in lower viral infectivity titers produced after transfection (FIGS. 9-12). Virus from fully infected cultures was passaged to naïve cells (Table 1b), and the complete ORF from $1^{st}$ passage cultures was sequenced (Table 12-17). HK6a/JFH1$_{1389,1590}$(HK6a-NS5A) and QC69/JFH1$_{2985}$(QC69-NS5A) did not acquire additional mutations. However, of these two only QC69/

Figure 13A:
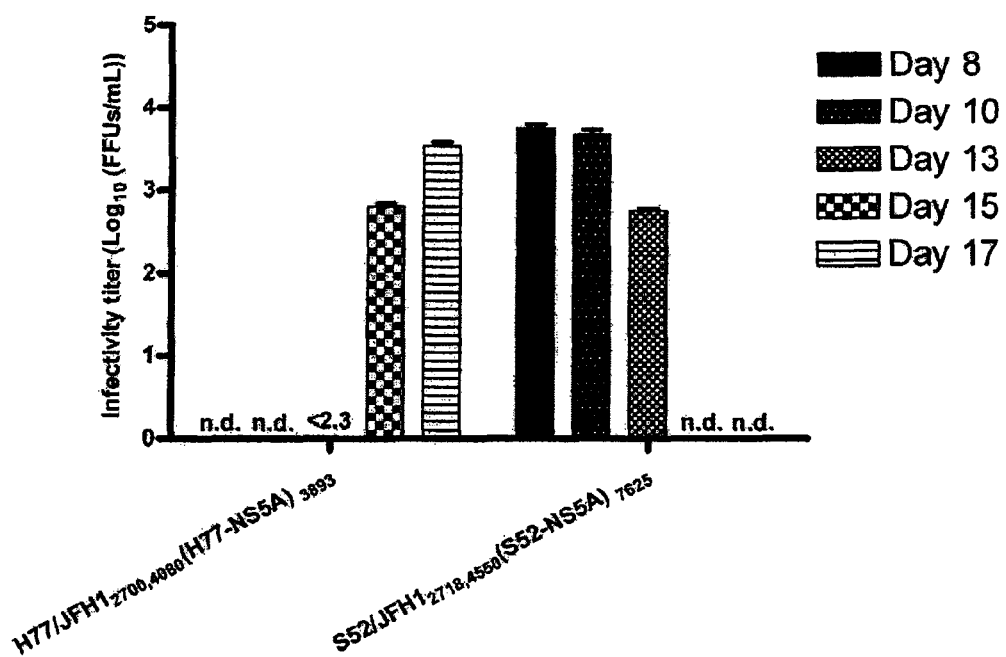
Figure 13B:
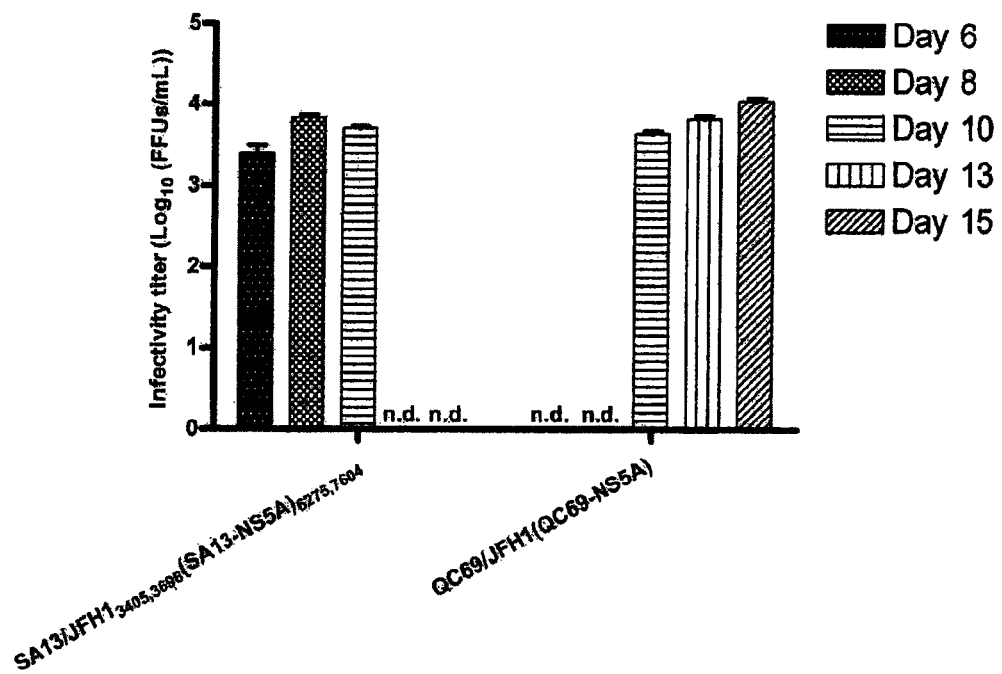

$JFH1_{2985}$(QC69-NS5A) produced infectivity titers above $10^3$ FFU/mL (FIG. 13*b* and data not shown).

Example 12

Development of Efficient 1a/JFH1(1a-NS5A) Systems

Sequencing of two independent passages of virus from each of the H77/$JFH1_{2700,4080}$(H77-NS5A) and TN/$JFH1_{4562}$(TN-NS5A) transfection culture revealed a number of putative adaptive mutations leading to infectivity titers in $1^{st}$ passage of $10^{3.3}$ and $10^{3.6}$ FFU/mL, respectively (Table 1b, 12 and 13). We analyzed the T3893A mutation in NS3 in reverse genetic studies (SEQ ID NO 45, deduced amino acid SEQ ID NO 126). Insertion of the 3893 mutation led to increased infectivity titers after transfection for the H77 but not for the TN recombinant (FIG. 9 and data not shown). After passage of H77/$JFH1_{2700,4080}$$(H77\text{-}NS5A)_{3893}$ to naïve cells infectivity titers of $10^{3.5}$ FFU/mL were produced (FIG. 13*a* and Table 2), and no additional mutations were identified by sequencing of the ORF of recovered viruses (Table 12).

Example 13

Development of 1b/JFH1(1b-NS5A) Systems

Transfection and $1^{st}$ passage of J4/$JFH1_{2996,4827}$(J4-NS5A) led to maximum infectivity titers of $10^{1.6}$ FFU/mL. Mutations in NS3 were identified by sequencing of the complete ORF from the $1^{st}$ passage culture (Table 1b and 14). We analyzed the T3893A mutation in NS3 in reverse genetic studies (SEQ ID NO 48, deduced amino acid SEQ ID NO 129). The 3893 mutation led to increased infectivity titers after transfection (FIG. 9). No additional mutations could be identified after passage of J4/$JFH1_{2996,4827}$$(J4\text{-}NS5A)_{3893}$ to naïve cells (Table 14).

Example 14

Development of Efficient 3a/JFH1(3a-NS5A) Systems

Sequencing of $1^{st}$ passage S52/$JFH1_{2718,4550}$(S52-NS5A) virus identified one single mutation in NS5A, T7625C (Table 15). Insertion of this mutation (SEQ ID NO 50, deduced amino acid SEQ ID NO 131) led to immediate production of relatively high infectivity titers after transfection (FIG. 9). After passage of S52/$JFH1_{2718,4550}$$(S52\text{-}NS5A)_{7625}$ to naïve cells infectivity titers of $10^{3.8}$ FFU/mL were produced (FIG. 13*a* and Table 2), and no additional mutations were identified when sequencing the complete ORF (Table 15).

Example 15

Development of 4a/JFH1(4a-NS5A) Systems

ED43/JFH1(ED43-NS5A) was transfected with and without mutations adaptive for ED43/JFH1. ED43/JFH1(ED43-NS5A) (SEQ ID NO 51, deduced amino acid SEQ ID NO 132) never spread in culture while transfection and $1^{st}$ passage of ED43/$JFH1_{2819,3269}$(ED43-NS5A) (SEQ ID NO 52, deduced amino acid SEQ ID NO 133) led to maximum infectivity titers of $10^{2.0}$ FFU/mL. A number of mutations were identified when sequencing the complete ORF of $1^{st}$, $2^{nd}$ and $3^{rd}$ passage ED43/$JFH1_{2819,3269}$(ED43-NS5A) virus (Table 1b and 16). Due to the low titers obtained we did not analyze these mutations in reverse genetic studies. Instead we inserted the T5282C/A7143G combination, known to provide adaptation to J6/JFH1(ED43-NS5A), into ED43/$JFH1_{2819,3269}$(ED43-NS5A). Analysis of viral spread after transfection showed the advantage of the ED43/$JFH1_{2819,3269}$$(ED43\text{-}NS5A)_{5270/7131}$ recombinant (having mutation of residues T5282C/A7143G, J6/JFH1(ED43-NS5A) numbering). While ED43/$JFH1_{2819,3269}$(ED43-NS5A) infected 1% of the culture on day 8 after transfection ED43/$JFH1_{2819,3269}$$(ED43\text{-}NS5A)_{5270/7131}$ (SEQ ID NO 193, deduced amino acid SEQ ID NO 194) infected 30% and spread to the majority of culture on day 17.

Example 16

Development of Efficient 5a/JFH1(5a-NS5A) Systems

SA13/JFH1(SA13-NS5A) was transfected with and without mutations adaptive for SA13/JFH1 (SEQ ID NO 53-54, deduced amino acid SEQ ID NO 134-135). For both, no replication was identified on day 1 after transfection, however, infection spread to the majority of culture on day 18 for SA13/$JFH1_{3405,3696}$(SA13-NS5A) and on day 20 for SA13/JFH1(SA13-NS5A). A number of putative adaptive mutations were identified when sequencing virus produced from $1^{st}$ passage cultures (Table 17). We analyzed the two commonly occurring mutations A6275G and T7604C in SA13/$JFH1_{3405,3696}$(SA13-NS5A) reverse genetic studies. Immediately after transfection, SA13/$JFH1_{3405,3696}$$(SA13\text{-}NS5A)_{6275,7604}$ (SEQ ID NO 55, deduced amino acid SEQ ID NO 136) produced relatively high viral titers (FIG. 10 and Table 1b), and could efficiently be passaged to naïve cells (FIG. 13*b* and Table 2). No additional mutations were observed when sequencing the ORF of $1^{st}$ passage virus (Table 17).

Example 17

Development of Efficient 6a/JFH1(6a-NS5A) Systems

After HK6a/JFH1(HK6a-NS5A) transfection and passage to naïve cells no putative adaptive mutations were observed, but infectivity titers produced were relatively low. Thus, we included T7155A identified for J6/JFH1(HK6a-NS5A) as an alternative putative adaptive mutation to generate HK6a/$JFH1(HK6a\text{-}NS5A)_{7161}$ (SEQ ID NO 57, deduced amino acid SEQ ID NO 138). After transfection, HK6a/JFH1$(HK6a\text{-}NS5A)_{7161}$ infectivity titers were enhanced compared to HK6a/JFH1(HK6a-NS5A) (FIG. 11 and Table 1b). HK6a/$JFH1(HK6a\text{-}NS5A)_{7161}$ was efficiently passaged to naïve cells, and infectivity titers of $10^{3.3}$ FFU/mL were produced (Table 2).

Example 18

Development of Efficient 7a/JFH1(7a-NS5A) Systems

The original construct of QC69/JFH1(QC69-NS5A) (SEQ ID NO 58, deduced amino acid SEQ ID NO 139) produced relatively high infectivity titers immediately after transfection (FIG. 12 and Table 1b), and no additional mutations were identified after passage to naïve cells. QC69/JFH1(QC69-NS5A) was efficiently passaged to naïve cells, and infectivity titers of $10^{4+1}$ FFU/mL were produced (FIG. 13b and Table 2). Thus, efficient NS5A systems for QC69 had been developed.

Example 19

Testing of Specific NS5A Inhibitors: Development of Putative Resistance Mutants

Figure 14:
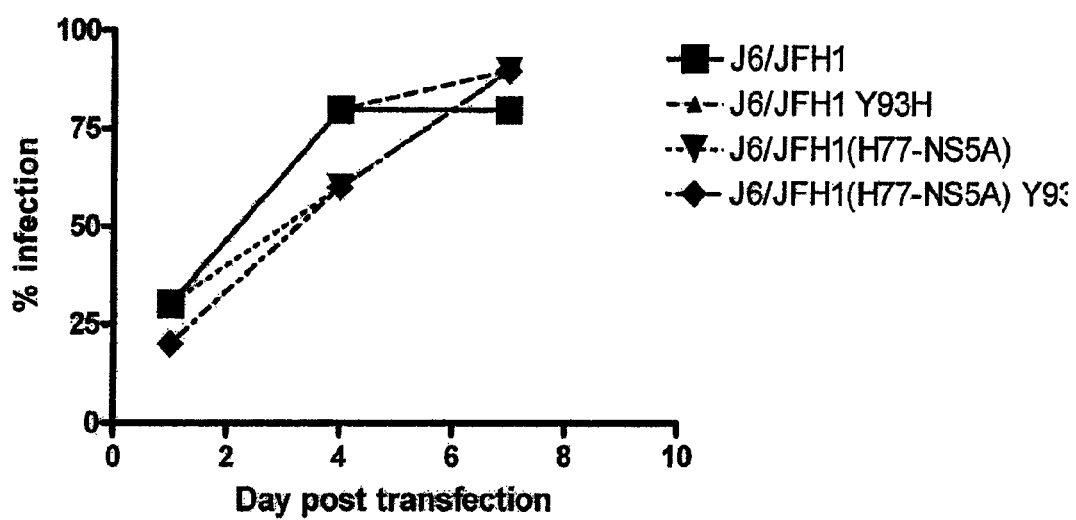

To demonstrate possibilities of testing resistance mutants in cell culture, the present inventors focused on the Y93H mutation in NS5A reported for the Bristol-Meyers-Squibb compound as well as several other compounds in development. Thus, Y93H (T93H for genotype 5a and 6a) was inserted into adapted recombinants of J6/JFH1 with NS5A of genotype 1a, 1b, 2a, 3a, 4a, 5a and 6a. Thus, the present inventors generated J6/JFH1(H77-NS5A)[Y93H], J6/JFH1(J4-NS5A)$_{2952/3905}$,[Y93H], J6/JFH1[Y93H], J6/JFH1(S52-NS5A)$_{6276}$, [Y93H], J6/JFH1(ED43-NS5A)$_{2667/5282/7143}$, [Y93H], J6/JFH1(SA13-NS5A)$_{6284/7604}$, [T93H] and J6/JFH1(HK6a-NS5A)$_{7155}$, [T93H]. QC69 already have H at NS5A position 93. RNA transcripts of Y93H mutants were transfected into Huh7.5 cells together with controls. Similar spread kinetics were observed for Y93H mutants and the respective control recombinants (FIG. 14).

Example 20

Figure 15:
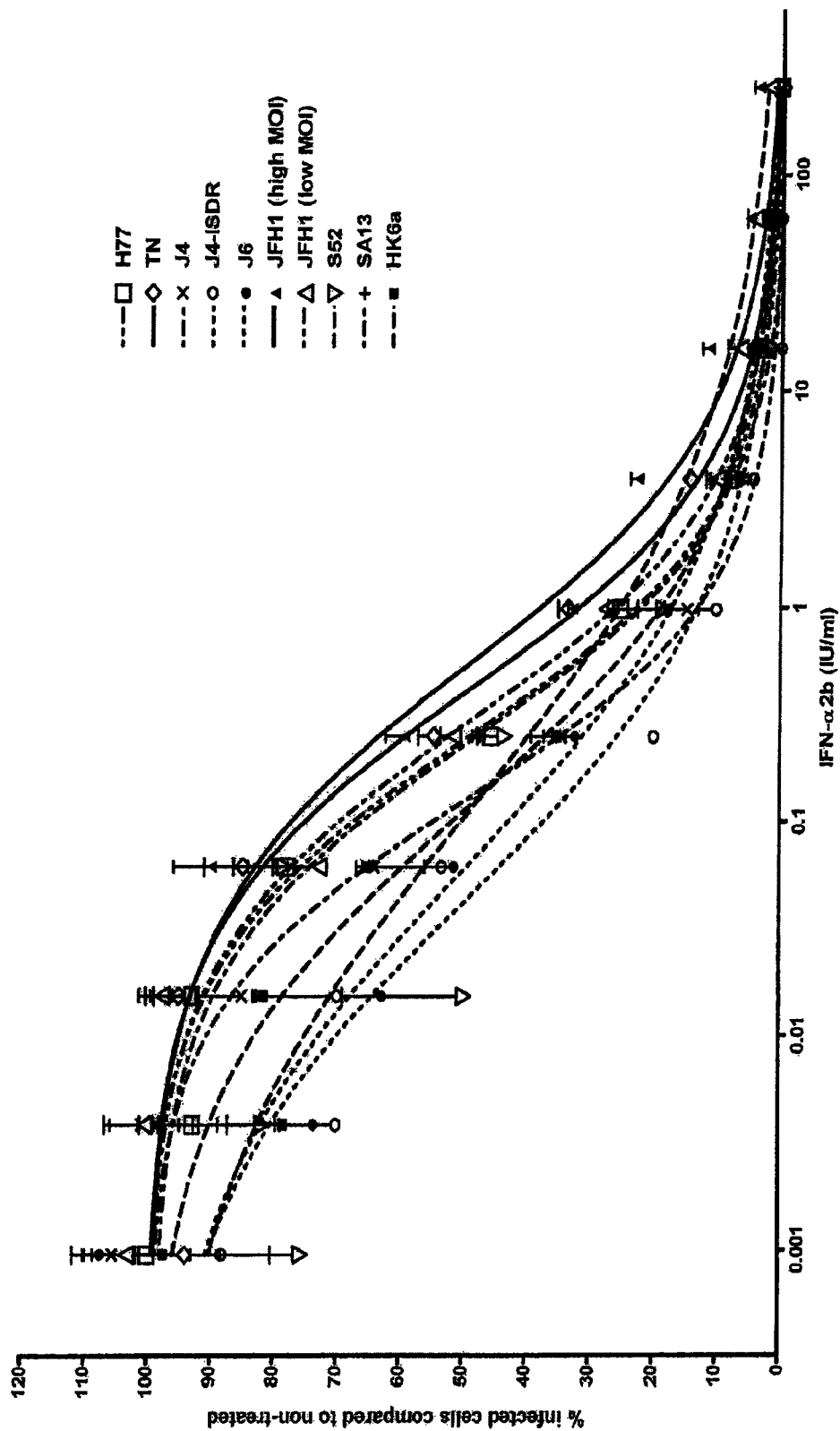
Figure 16:
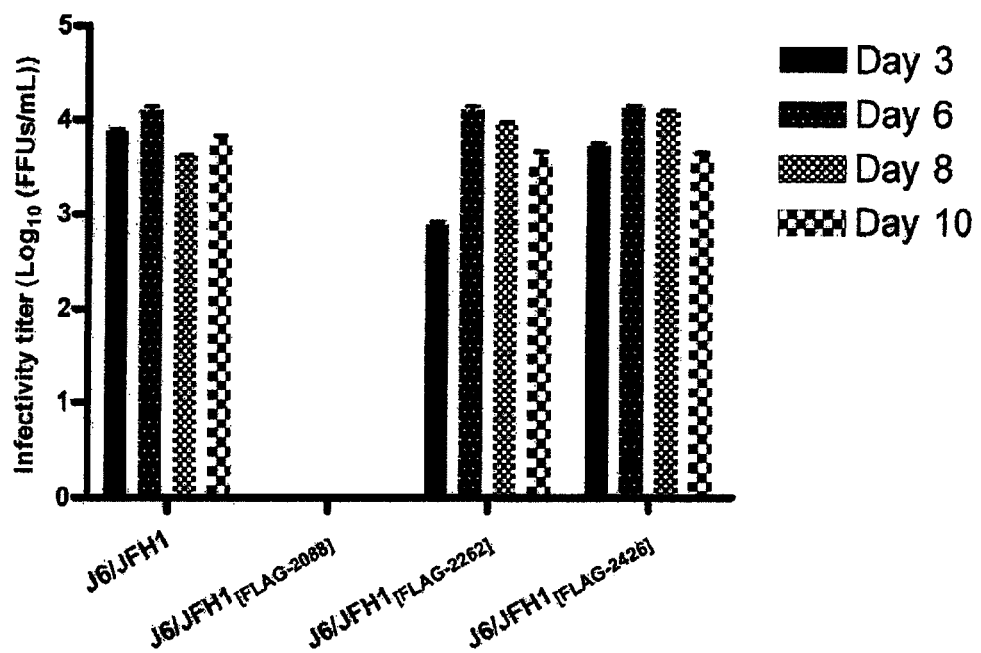
Figure 17:
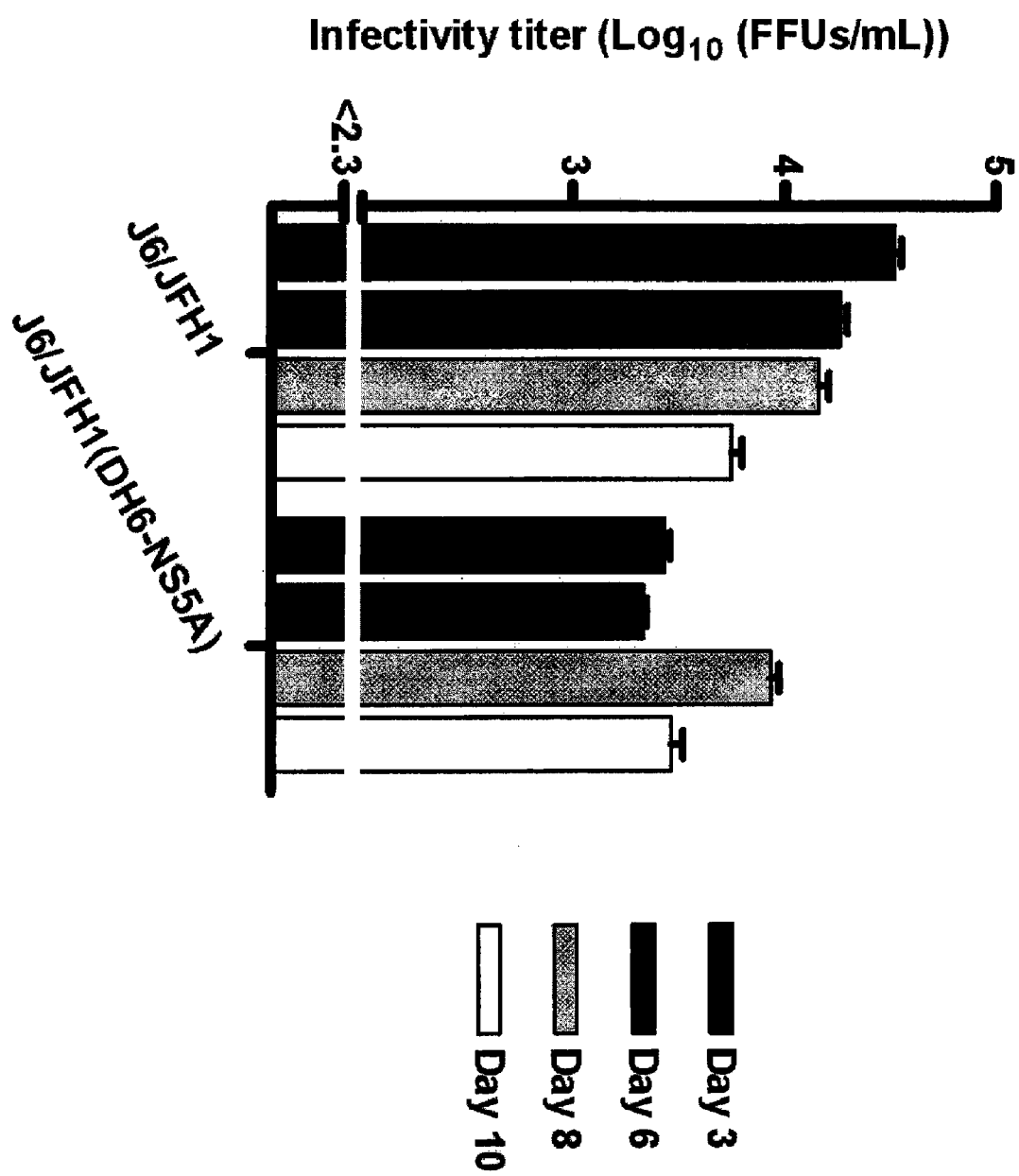
Figure 18:
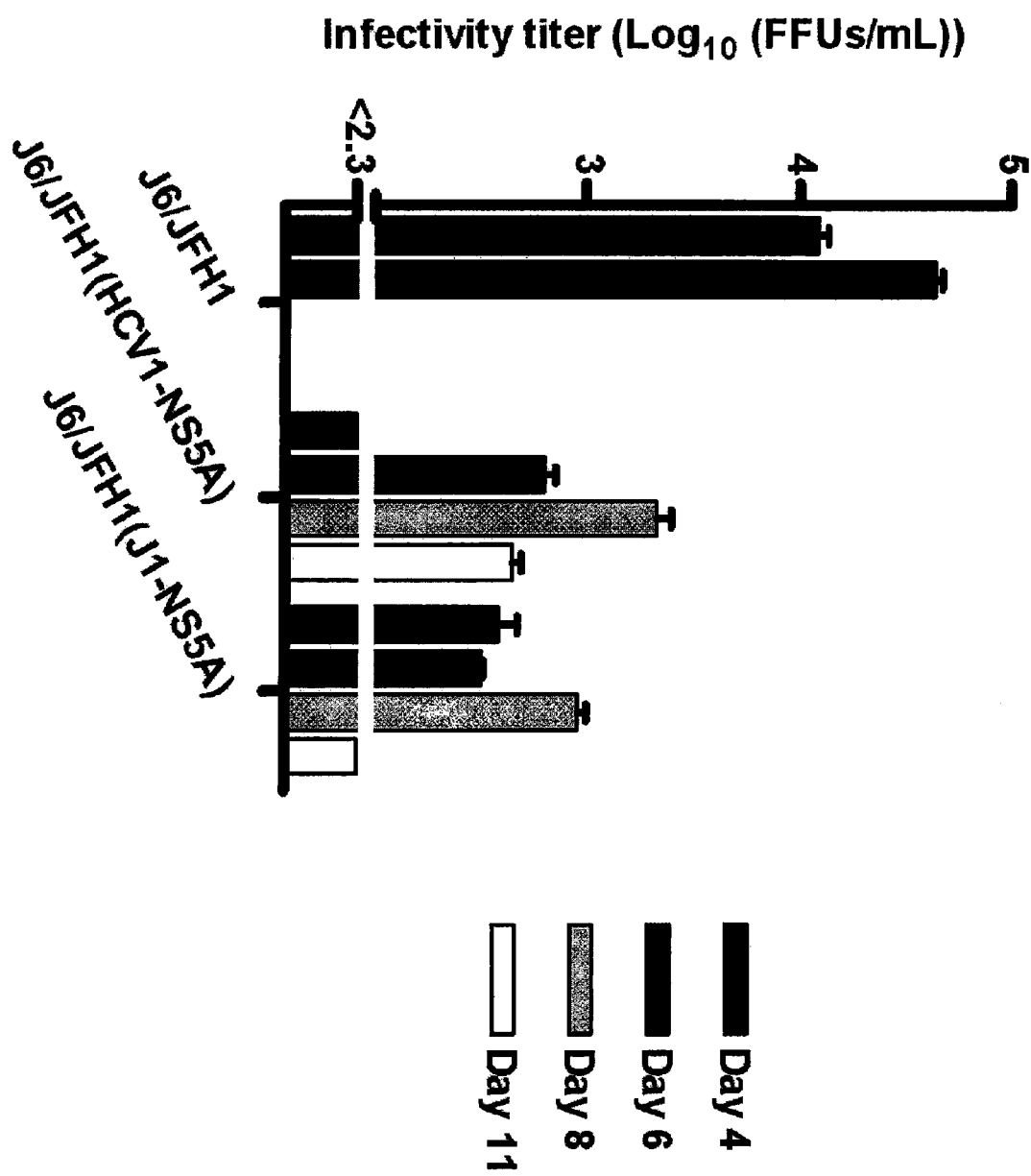

Testing of Antivirals: Genotype-Specific Effect of Treatment with Interferon-Alpha J6/JFH1 recombinants with genotype specific NS5A and the genotype 1b ISDR mutant were used to study the antiviral effect of IFN-alpha in cell culture. Huh7.5 cells infected with J6/JFH1 with NS5A of the various genotypes were treated with IFN-alpha 2b at the given dose one and two days after infection. On day three cells were fixed and immunostained for NS3 expression. The number of single infected cells was determined by automated counting (FIG. 15). The data show that IFN-alpha inhibited cell culture infection with different NS5A genotypes in a dose-dependent manner. The data shown in FIG. 15 indicate that certain isolates might be more responsive to IFN-alpha treatment, and that the ISDR region likewise might play a role.

Example 21

Replicon Enhancing Mutations are Attenuating in Cell Culture

Due to lack of culture systems recapitulating the complete viral life cycle, most studies of HCV replication and development of inhibitors has relied on the replicon system, in particular genotype 1b systems. The efficient replication in these systems in most cases rely on replicon enhancing mutations, with JFH1 of genotype 2a being an exception. Previously it was found that certain replicon enhancing mutations attenuated infection in vivo. With the availability of cell culture systems with genotype 1b NS5A, we tested how replicon enhancing mutations in NS5A affected viability in cell culture. Replicon enhancing mutations S225P (S2197P on the complete H77 reference genome) and Δ47 (a 47 amino acid deletion in NS5A domain II of residues 235-282 (H77 NS5A reference sequence) and replacement by tyrosin) were highly attenuating in the complete viral lifecycle J6/JFH1(J4-NS5A)$_{2952/3905}$ system. In analogy to observations in vivo S225P (S2197P) mutants were only viable in cell culture after reversion of proline to serine. This demonstrates the closer relationship of cell culture systems to in vivo conditions compared to the replicon system. Creating conditions as close to what is observed in vivo is obviously of uttermost importance in screening of novel antivirals and for functional analysis of HCV.

Example 22

Attenuating Point Mutations in NS5

To prove the stability of the developed systems and to determine whether individual domains of NS5A harbor vital functions, we engineered point mutations into efficient and genetically stable J6/JFH1 based NS5A recombinants of genotypes 1-7 [J6/JFH1(H77-NS5A), J6/JFH1(J4-NS5A)$_{2952/3905}$, J6/JFH1, J6/JFH1(S52-NS5A)$_{6276}$, J6/JFH1 (ED43-NS5A)$_{2667/5282/7143}$, J6/JFH1(SA13-NS5A)$_{6284/7604}$, J6/JFH1(HK6a-NS5A)$_{7155}$ and J6/JFH1(QC69-NS5A)]. We found that the following mutations were highly attenuating for replication of all NS5A isolates tested (as monitored by anti-Core immunostaining) after RNA transfection into Huh7.5 cells: V12E (112E for genotype 1) in the N-terminal amphipathic alpha helix (considered important for membrane localization of NS5A), C57G combined with C59G in domain II (considered important for Zinc-ion binding), S225P in the interdomain region LCSI (described above) and W329A in domain II (data not shown, all numbering according to H77 NS5A amino acid reference sequence).

Example 23

Development of NS5A Systems that Allow for Insertion of Reporter Gene

To develop NS5A reporter systems for NS5A of all genotypes, the present inventors here describe development of viable NS5A deletion mutants across all major genotypes. Initially, we generated Δ40-mutants for J6/JFH1 with NS5A of genotype 1a (for genotype 1a, the equivalent region is 44 amino acids). Thus we generated J6/JFH1(H77-NS5A)$_{\Delta 44}$ and J6/JFH1(TN-NS5A)$_{\Delta 44}$ (SEQ ID NO 66-68, deduced amino acid SEQ ID NO 147-149). After transfection of RNA transcripts J6/JFH1$_{\Delta 40}$ and J6/JFH1(TN-NS5A)$_{\Delta 44}$ exhibited no delay in spread of infection in culture compared to J6/JFH1 and J6/JFH1(TN-NS5A). J6/JFH1(H77-NS5A)$_{\Delta 44}$ was slightly delayed compared to J6/JFH1(H77-NS5A). Infectivity titers of at least $10^4$ FFU/mL were obtained for deletion-mutants with NS5A of genotype 1a and 2a in transfection or after passage to naïve cells (Table 3). After sequencing of the ORF of virus released in $1^{st}$ passage, putative adaptive mutations were identified (Table 18 and 19).

The possibility to insert EGFP in a highly conserved region in NS5A domain III inspired us to construct deletion mutants of this region. Thus the present inventors deleted a highly conserved 15 amino acid motif in NS5A of genotypes 1a, 1b, 2a, 3a, 4a, 5a, 6a and 7a (residues 414-428 on H77 reference NS5A amino acid sequence) to generate J6/JFH1(H77-NS5A)$_{\Delta 15}$, J6/JFH1(TN-NS5A)$_{\Delta 15}$, J6/JFH1(J4-NS5A)$_{2952/3905/\Delta 15}$, J6/JFH1$_{\Delta 15}$, J6/JFH1(J6-NS5A)$_{T2667C,\Delta 15}$, J6/JFH1(S52-NS5A)$_{6276,\Delta 15}$, J6/JFH1(ED43-NS5A)$_{2667/5282/7143,\Delta 15}$, J6/JFH1(SA13-NS5A)$_{6284/7604,\Delta 15}$, J6/JFH1(HK6a-NS5A)$_{7155,\Delta 15}$ and J6/JFH1(QC69-NS5A)$_{\Delta 15}$ (SEQ ID NO 69-78, deduced amino acid SEQ ID NO 150-159). After transfection of RNA transcripts of J6/JFH1(H77-NS5A)$_{\Delta 15}$, J6/JFH1(TN-NS5A)$_{\Delta 15}$, J6/JFH1$_{\Delta 15}$, J6/JFH1(J6-NS5A)$_{T2667C,\Delta 15}$, J6/JFH1(S52-NS5A)$_{6276,\Delta 15}$, J6/JFH1(ED43-

NS5A)$_{2667/5282/7143,\Delta15}$ and J6/JFH1(SA13-NS5A)$_{6284/7604,\Delta15}$ no delay in viral spread compared to the respective controls were observed. After viral passage to naïve cells, infectivity titers of at least $10^{3.5}$ FFU/mL were observed for genotype 1a and 2a (others not analysed) (Table 3). After sequencing of the ORF of H77 and TN NS5A virus with Δ15 released in 1$^{st}$ passage, putative adaptive mutations were identified (Table 18 and 19).

Example 24

Development of Efficient Recombinants Expressing Epitope Tagged NS5

We inserted the FLAG-tag (amino acid sequence DDDDK) at three different positions in J6/JFH1 NS5A (after residue 2088, 2262 and 2426 on J6/JFH1, residue 2084, 2262 and 2402 on the H77 amino acid reference sequence, SEQ ID NO 79-81, deduced amino acid SEQ ID NO 160-162). After transfection of RNA transcripts into Huh7.5 cells $J6/JFH1_{FLAG\text{-}2262}$ and $J6/JFH1_{FLAG\text{-}2426}$ immediately spread in culture and produced infectivity titers comparable to J6/JFH1 (FIG. 16 and Table 1a). $J6/JFH1_{FLAG\text{-}2088}$ showed very limited replication and was not investigated further. $J6/JFH1_{FLAG\text{-}2262}$ and $J6/JFH1_{FLAG\text{-}2426}$ virus could efficiently be passaged to naïve cells; infectivity titers of around $10^4$ FFU/mL were produced in 1st passage cultures. No additional mutations were observed when sequencing the entire ORF of 1st passage culture virus. Thus, we demonstrated the development of efficient NS5A epitope tag HCV recombinants.

Example 25

Development of Genotype 1a-NS5A Recombinants

To investigate intra-genotypic deviations in sensitivity to antivirals for genotype 1a, we developed additional NS5A recombinants of isolates DH6(1a), HCV-1(1a) and J1(1a) (SEQ ID 195, 196 and 197, respectively, encoding the corresponding polyproteins, SEQ ID 198, 199 and 200), which like the H77C(1a) and TN(1a) NS5A recombinants all spread in culture immediately after transfection and produced infectious virus (FIGS. 17 and 18).

HCV NS5A DH6 consensus sequences were derived by RT-PCR and cloning of RNA extracted from chronic-phase patient serum. The HCV-1 (GenBank accession number AF271632) and 31 (GenBank accession number D10749) sequences were synthetically produced (GenScript). The complete NS5A gene and mutations were inserted into J6/JFH1 by standard cloning procedures. The final DH6(1a) recombinant deviated from the determined consensus sequence at three non-coding positions (G6695A, T6749G and A6890G).

FIGS. 17 and 18 show HCV infectivity titers after transfection of RNA transcripts of J6/JFH1-based genotype is recombinants into Huh7.5 hepatoma cells. RNA transcripts of J6/JFH1 (controls) and NS5A recombinants with genotype-specific NS5A were transfected into Huh7.5 cells. Infectivity titers (focus-forming units (FFU)/mL) in supernatant were determined on days after transaction as indicated.

Example 26

Treatment of Infected Cultures with the Specific NS5A Inhibitor, BMS-790052

To improve HCV treatment, much attention has been drawn to development of specific small molecule HCV inhibitors, including inhibitors of NS5A. Using the NS5A genotype recombinants, we investigated sensitivity to the NS5A inhibitor most advanced in clinical trials, BMS-790052. Treatment experiments using the specific NS5A inhibitor BMS-790052 (synthesized by Acme Bioscience, Palo Alto, Calif., USA) were conducted similar to what was described for interferon-alpha. In a high-throughput assay, $EC_{50}$ values were <0.1 nM for most isolates, with J4(1b) being most sensitive (0.009 nM), comparable to observations in patient studies. More resistant were J6(2a), J1(1a) and S52(3a) with $EC_{50}$ values of 14, 1.1 and 0.9 nM, respectively (Table 21).

Mutations of NS5A residues 30, 31 and 93 were reported to confer resistance to this drug class in vivo and in vitro. The best described resistance mutation for this drug class, change of NS5A residue 93, induced >10-fold resistance to BMS-790052 for genotype 1 replicons. We changed this residue to histidine in the NS5A genotype 1-6 recombinants; QC69(7a) naturally had histidine. In BMS-790052 treatment experiments, H77C(1a)-Y93H, JFH1(2a)-Y93H and S52(3a)-Y93H were >1000-fold, J4(1b)-Y93H, J6(2a)-Y93H and ED43(4a)-Y93H~100-fold, and SA13(5a)-T93H and HK6a (6a)-T93H<5-fold more resistant than the respective original recombinants (Table 21). We further studied other putative resistance mutations as indicated in Table 21, and found mutations of NS5A residues L31M and C92E in the J6/JFH1 background, or exchange of the JFH1 NS5A domain I to the corresponding 36 sequence, to confer resistance to BMS-790052. The presence of L31M in the J6(2a) isolate and C92E in the S52(3a) isolate corresponded to the higher resistance of these isolates. Further, the lower sensitivity of J1(1a) compared to other 1a recombinants could be caused by the histidine found at NS5A residue 30, previously associated with resistance in patients.

Overall, the response to the specific NS5A inhibitor BMS-790052, currently in clinical trials, seemed to strongly depend on the NS5A isolate and to be determined by complex sequence-specific determinants in the NS5A protein.

Tables

Table 1a and 1

Maximum infectivity and RNA titers of NS5A recombinants after transfection into Huh7.5 cells and passage to naïve cells. A: After transfection of RNA transcripts of J6/JFH1-based NS5A recombinants with or without putative adaptive mutations, infectivity released to the supernatant was followed by titrations of focus-forming units (FFU)/mL. Maximum titers are shown.

Repeated experiments with the same recombinant are shown with identical names following each other. Supernatants from selected transfection cultures were passaged to naïve Huh7.5 cells. Infectivity titers and HCV RNA titers (IU/mL) in viral passages were determined. Maximum titers are shown. B: Maximum infectivity and HCV RNA titers are shown for experiments with genotype-specific NS5A recombinants with Core-NS2 of the same genotype. Two independent passage experiments were done from the same transfection culture where two values are given separated by a slash.

TABLE 1a

| | Peak titers NS5A exchange study | | |
|---|---|---|---|
| | Transfection | 1st passage | |
| HCV recombinant | Log(FFU/mL) | Log(FFU/mL) | Log(IU/mL) |
| J6/JFH1(H77-NS5A) | 3.2 | 3.7 | 7.2 |
| J6/JFH1(H77-NS5A) | 3.2 | | |
| J6/JFH1(H77-NS5A) | 3.0 | 4.0 | |
| J6/JFH1(H77-NS5A)$_{2667}$ | 3.4 | 3.9 | 7.4 |
| J6/JFH1(TN-NS5A) | 3.1 | 3.8 | 6.9 |
| J6/JFH1(TN-NS5A) | 3.5 | | |
| J6/JFH1(TN-NS5A) | | 4.1 | |
| J6/JFH1(TN-NS5A)$_{2667}$ | 3.3 | 3.4 | 6.5 |
| J6/JFH1(J4-NS5A) | 2.2 | 3.7 | 7.2 |
| J6/JFH1(J4-NS5A) | 2.2 | | |
| J6/JFH1(J4-NS5A)$_{2667}$ | 1.8 | | |
| J6/JFH1(J4-NS5A)$_{2952}$ | 2.9 | | |
| J6/JFH1(J4-NS5A)$_{3905}$ | 3.6 | 3.7 | 6.8 |
| J6/JFH1(J4-NS5A)$_{2952/3905}$ | 3.7 | 3.8 | 7.2 |
| J6/JFH1(J4-NS5A)$_{2952/3905}$ | 4.2 | | |
| J6/JFH1(J4-NS5A)$_{2952/3905}$ | | 3.9 | |
| J6/JFH1(J4-NS5A)$_{2952/3905}$ | 4.1 | | |
| J6/JFH1(J4-NS5A)$_{2952/3905, ISDRmut}$ | 3.5 | 3.7 | 7.0 |
| J6/JFH1$_{[FLAG-2262]}$ | 4.1 | 3.9 | |
| J6/JFH1$_{[FLAG-2426]}$ | 4.2 | >4.0 | |
| J6/JFH1(J6-NS5A) | 3.0 | 3.6 | 6.9 |
| J6/JFH1(J6-NS5A) | 4.1 | | |
| J6/JFH1(J6-NS5A)$_{2667}$ | 4.5 | 4.3 | 7.2 |
| J6/JFH1(S52-NS5A) | 2.9 | 3.3 | 6.5 |
| J6/JFH1(S52-NS5A) | 3.6 | | |
| J6/JFH1(S52-NS5A)$_{2667}$ | 3.2 | | |
| J6/JFH1(S52-NS5A)$_{2693}$ | 3.7 | | |
| J6/JFH1(S52-NS5A)$_{3473}$ | 3.1 | | |
| J6/JFH1(S52-NS5A)$_{4862}$ | 3.7 | | |
| J6/JFH1(S52-NS5A)$_{6276}$ | 4.0 | 3.7 | 6.8 |
| J6/JFH1(S52-NS5A)$_{7580}$ | 4.0 | | |
| J6/JFH1(S52-NS5A)$_{2693/4862}$ | 3.9 | | |
| J6/JFH1(S52-NS5A)$_{2693/6276}$ | 4.1 | 3.8 | 7.3 |
| J6/JFH1(S52-NS5A)$_{2693/7580}$ | 4.2 | | |
| J6/JFH1(S52-NS5A)$_{2693/4862/6276/7580}$ | 4.2 | 4.1 | 7.5 |
| J6/JFH1(ED43-NS5A) | | 3.5 | 7.0 |
| J6/JFH1(ED43-NS5A) | 2.8 | 3.3 | 7.5 |
| J6/JFH1(ED43-NS5A) | 2.5 | | |
| J6/JFH1(ED43-NS5A)$_{2667}$ | 3.2 | 3.9 | 7.0 |
| J6/JFH1(ED43-NS5A)$_{2667}$ | 4.2 | | |
| J6/JFH1(ED43-NS5A)$_{2667}$ | 3.6 | | |
| J6/JFH1(ED43-NS5A)$_{5282}$ | 3.6 | | |
| J6/JFH1(ED43-NS5A)$_{7143}$ | 4.1 | | |
| J6/JFH1(ED43-NS5A)$_{7143}$ | 3.6 | 4.3 | 7.3 |
| J6/JFH1(ED43-NS5A)$_{7587}$ | 4.1 | | |
| J6/JFH1(ED43-NS5A)$_{2667/5282}$ | 4.1 | 4.3 | 7.6 |
| J6/JFH1(ED43-NS5A)$_{2667/7143}$ | 4.1 | | |
| J6/JFH1(ED43-NS5A)$_{2667/7143}$ | 3.6 | 4.3 | 7.3 |
| J6/JFH1(ED43-NS5A)$_{2667/7587}$ | 4.2 | | |
| J6/JFH1(ED43-NS5A)$_{2667/5282/7143}$ | 3.6 | 4.2 | 7.2 |
| J6/JFH1(ED43-NS5A)$_{2667/5282/7143}$ | 3.1 | 3.9 | |
| J6/JFH1(SA13-NS5A) | 3.6 | 4.1 | 6.6 |
| J6/JFH1(SA13-NS5A)$_{2667}$ | <2.3 | | |
| J6/JFH1(SA13-NS5A)$_{6284}$ | 3.2 | 3.1 | 6.7 |
| J6/JFH1(SA13-NS5A)$_{6284/7023}$ | 3.6 | | |
| J6/JFH1(SA13-NS5A)$_{6284/7278}$ | 2.1 | | |
| J6/JFH1(SA13-NS5A)$_{6284/7604}$ | 3.8 | 3.8 | 6.3 |
| J6/JFH1(SA13-NS5A)$_{2667/6284}$ | 3.5 | 3.7 | (6.8) |
| J6/JFH1(HK6a-NS5A) | 1.8 | 4.1 | 7.1 |
| J6/JFH1(HK6a-NS5A) | 3.1 | | |
| J6/JFH1(HK6a-NS5A) | 2.5 | | |
| J6/JFH1(HK6a-NS5A)$_{2667}$ | 2.8 | | |
| J6/JFH1(HK6a-NS5A)$_{7155}$ | 3.2 | 4.1 | |
| J6/JFH1(QC69-NS5A) | 3.5 | 4.0 | 7.2 |

TABLE 1b

| HCV recombinant | Transfection Log(FFU/mL) | 1st passage Log(FFU/mL) | 1st passage Log(IU/mL) |
|---|---|---|---|
| H77/JFH1$_{2700, 4080}$(H77-NS5A) | 2.6 | 3.3/3.3 | 7.1/6.9 |
| H77/JFH1$_{2700, 4080}$(H77-NS5A) | <2.3 | | |
| H77/JFH1$_{2700, 4080}$(H77-NS5A)$_{3893}$ | 2.7 | 3.5 | |
| TN/JFH1$_{4562}$(TN-NS5A) | 2.0 | 3.6/2.4 | 7.4/6.8 |
| TN/JFH1$_{4562}$(TN-NS5A) | 2.3 | | |
| J4/JFH1$_{2996, 4827}$(J4-NS5A) | 1.6 | 1.0/1.3 | 5.8/6.6 |
| J4/JFH1$_{2996, 4827}$(J4-NS5A) | <2.3 | | |
| J4/JFH1$_{2996, 4827}$(J4-NS5A)$_{3893}$ | 2.5 | <2.3 | |
| S52/JFH1$_{2718, 4550}$(S52-NS5A) | 2.1 | 3.1 | 7.0 |
| S52/JFH1$_{2718, 4550}$(S52-NS5A) | 2.4 | | |
| S52/JFH1$_{2718, 4550}$(S52-NS5A)$_{7625}$ | 2.9 | 3.8 | |
| ED43/JFH1$_{2819, 3269}$(ED43-NS5A) | 1.4 | 1.8 | 7.1 |
| ED43/JFH1$_{2819, 3269}$(ED43-NS5A) | 2.0 | | |
| SA13/JFH1(SA13-NS5A) | 4.0 | | |
| SA13/JFH1$_{3405, 3696}$(SA13-NS5A) | 3.4 | 4.4 | 7.8 |
| SA13/JFH1$_{3405, 3696}$(SA13-NS5A) | <2.3 | | |
| SA13/JFH1$_{3405, 3696}$(SA13-NS5A)$_{6284, 7604}$ | 4.5 | 3.8 | |
| HK6a/JFH1$_{1389, 1590}$(HK6a-NS5A) | 1.4 | 0.8 | 7.0 |
| HK6a/JFH1$_{1389, 1590}$(HK6a-NS5A) | 2.2 | 2.7 | |
| HK6a/JFH1$_{1389, 1590}$(HK6a-NS5A) | <2.3 | | |
| HK6a/JFH1$_{1389, 1590}$(HK6a-NS5A)$_{7161}$ | 2.7 | 3.3 | |
| QC69/JFH1$_{2985}$(QC69-NS5A) | 2.7 | 4.1 | 7.3 |

Table 2

Characteristics of final genotype-specific NS5A recombinants. For genetically stable NS5A recombinants the engineered adaptive mutations and potential presence of mutations in NS5A are shown. In addition, the maximum infectivity titers observed in transfection and viral passage experiments are given. HCV RNA titers shown are the maximum observed in all passage samples analyzed for the given recombinant and do not necessarily originate from the same sample for which the maximum infectivity titer is shown. n.d.: not done.

| Genotype | | NS5A (complete gene) | | | Peak titers | | | Genetically stable |
|---|---|---|---|---|---|---|---|---|
| | | | | | Transfection | Viral passage | | |
| Genotype | Backbone Recombinant | Genotype | Isolate | Adaptive mutations | Log (FFUs/mL) | Log (FFUs/mL) | Log (IU/mL) | |
| 2a | J6/JFH1 | 1a | H77 | None | 3.2 | 4.1 | 7.2 | Yes |
| | | | TN | None | 3.5 | 4.1 | 6.9 | Yes |
| | | 1b | J4 | T3905A | 3.6 | 3.7 | 6.8 | Yes |
| | | | | G2952A/T3905A | 4.2 | 4.2 | 7.2 | Yes |
| | | | | G2952A/T3905A, ISDRmut | 3.5 | 3.7 | 7.0 | Yes |
| | | 2a | JFH1 | None (original J6/JFH1) | 4.6 | 5.0 | 7.6 | Yes |
| | | | J6 | T2667C | 4.5 | 4.3 | 7.2 | Yes |
| | | 3a | S52 | A6276G | 4.0 | 4.4 | 6.8 | Yes |
| | | | | C2693G/A6276G | 4.1 | 3.8 | 7.3 | Yes |
| | | | | C2693G/A4862C/A6276G/T7580C | 4.2 | 4.1 | 7.5 | Yes |
| | | 4a | ED43 | T2667C/T5282C/A7143G | 3.6 | 4.2 | 7.2 | Yes |
| | | 5a | SA13 | A6284G | 3.2 | 3.1 | 6.7 | Yes |
| | | | | A6284G/A7604G | 3.8 | 3.8 | 6.3 | Yes |
| | | 6a | HK6a | T7155A | 3.2 | 4.1 | n.d. | |
| | | 7a | QC69 | None | 3.5 | 4.0 | 7.2 | Yes |
| 1a | H77/JFH1$_{T2700C, A4080T}$ | 1a | H77 | T3893A | 2.7 | 3.5 | n.d. | Yes |
| | TN/JFH1$_{C4562T}$ | | TN | None | 2.0 | 3.6 | 7.4 | No |
| 1b | J4/JFH1$_{T2996C, A4827T}$ | 1b | J4 | T3893A | 2.5 | <2.3 | n.d. | Yes |
| 3a | S52/JFH1$_{T2718G, A4550C}$ | 3a | S52 | T7625C | 2.9 | 3.8 | n.d. | Yes |
| 4a | ED43/JFH1$_{A2819G, A3269T}$ | 4a | ED43 | None | 2.0 | 1.8 | 7.1 | No |
| 5a | SA13/JFH1$_{C3405G, A3696G}$ | 5a | SA13 | A6275G/T7604C | 4.5 | 3.8 | n.d. | Yes |
| 6a | HK6a/JFH1$_{T1389C, A1590C}$ | 6a | HK6a | T7161A | 2.7 | 3.3 | n.d. | |
| 7a | QC69/JFH1$_{T2985C}$ | 7a | QC69 | None | 2.7 | 4.1 | 7.3 | Yes |

Table 3

Maximum infectivity titers of NS5A recombinants with deletions in domain III after transfection into Huh7.5 cells and passage to naïve cells. After transfection of RNA transcripts of J6/JFH1-based NS5A recombinants with deletions in NS5A domain III, infectivity released to the supernatant was followed by titrations of focus-forming units (FFU)/mL. Maximum titers are shown. Supernatants from selected transfection cultures were passaged to naïve Huh7.5 cells. Infectivity titers in viral passages were determined. Maximum titers are shown.

| Recombinant | Transfection Log(FFU/mL) | Viral passage Log(FFU/mL) |
|---|---|---|
| J6/JFH1(H77-NS5A)d44 | <2.3 | |
| J6/JFH1(H77-NS5A)d15 | <2.3 | 4 |
| J6/JFH1(TN-NS5A)d44 | 2.8 | 4.1 |
| J6/JFH1(TN-NS5A)d15 | 3.0 | 4 |
| 36/JFH1d40 | 4.0 | |
| 36/JFH1d15 | 4.0 | 4.1 |
| J6/JFH1(J6-NS5A)d15 | 3.6 | 3.5 |

Table 4-19

Genetic stability of NS5A recombinants after passage to naïve cells. Supernatant samples from transfection culture were passaged to naïve Huh7.5 cells and the complete ORF was sequenced after spread of infection in culture to check for further need of adaptation.

†Positions are numbered according to the specific HCV recombinant. Corresponding H77 (AF009606) absolute reference positions are given. Coding mutations with at least 50/50 presence are shown. For positions with mixtures both nucleotides are given. Highlighted positions are mutations engineered into given recombinant. In addition the following non-coding mutations were observed: J6/JFH1(H77-NS5A), 1st, day 15: T4888T/C; J6/JFH1(H77-NS5A)T2667C, 1st, day 11: T9326T/C; TN/JFH1C4562T(TN-NS5A), 1st, day 6: C739C/T; J6/JFH1(TN-NS5A)T2667C, 1st, day 8: T1762C; J4/JFH1T2996C, A4827T(J4-NS5A), 1st, day 22: T3877C/T, G4399G/A; J6JFH1(J4-NS5A)2952/3905, 1st, day 8: A3952G; J6-JFH1(J6-NS5A)2667, 1st, day 10: C6820A; J6/JFH1(S52-NS5A), 1st, day 14: A3631A/G, A6577A/C; J6/JFH1(ED43-NS5A), 1st, day 22: C1831T, C3922C/T, G9238G/A; J6/JFH1(ED43-NS5A), 3rd, day 12: G6967A; 36-JFH1(ED43-NS5A)7143, 1st, day 8: A1948G, G6616G/A; 36-JFH1(ED43-NS5A)2667/7143, 1st, day 8: C3055T, A6454C; 36-3FH1(ED43-NS5A)2667/5282/7143, 1st, day 8: A2482A/G, T3211T/C; ED43/JFH1(ED43-NS5A), 1st, day 19: T865T/C, C8266C/T; ED43/JFH1(ED43-NS5A), 2nd, day 12: T865T/C, A1048A/G, C8266T, A8368G; ED43/JFH1(ED43-NS5A), 3rd, day 14: G1828A, T4484T/C, C8266T; J6/JFH1(SA13-NS5A), 1st, day 6: A2377A/G, C2747C/T, C7900C/G; J6/JFH1(SA13-NS5A)A6284G/A7604G, 1st, day 10: T1582T/G, T3946C; J6/JFH1(SA13-NS5A)T2667C/A6284G, 1st, day 10: T2705C; SA13/JFH1$_{3405,3696}$(SA13-NS5A), 1st, day 8: T9005T/C; J6/JFH1(HK6a-NS5A), 1st, day 13: T8110T/C; J6/JFH1(H77-NS5A), d44, 1st, day 17: T8578T/C; J6/JFH1(TN-NS5A), d44, 1st, day 14: T6205T/A, T6538T/A; J6/JFH1(TN-NS5A), d15, 1st, day 14: C4522T, T4687T/C, A7201G, A7519C;

TABLE 4

| HCV gene | | p7 | NS3 | NS3 | NS3 | NS5A | NS5A | NS5A |
|---|---|---|---|---|---|---|---|---|
| Nucleotide number† | | | | | | | | |
| Specific | | 2667 | 4032 | 4727 | 5195 | 6330 | 7266 | 7607 |
| H77 abs ref | | 2656 | 4021 | 4716 | 5184 | 6319 | 7255 | 7596 |
| Plasmid seq | | T | A | A | A | C | A | T |
| Construct | Passage | | | | | | | |
| J6/JFH1(H77-NS5A) | 1st, day8 | | | | | | | |
| J6/JFH1(H77-NS5A) | 1st, day15 | | | | | | | |
| J6/JFH1(H77-NS5A)$_{2667}$ | 1st, day11 | C | A/T | T | G | T | T | C |
| Amino acid | | | | | | | | |
| Specific | | 776 | 1231 | 1463 | 1619 | 1997 | 2309 | 2423 |
| H77 abs ref | | 772 | 1227 | 1459 | 1615 | 1993 | 2305 | 2419 |
| Change | | F > S | Y > F | T > S | K > E | T > I | D > V | C > R |

TABLE 5

| HCV gene | | p7 | NS3 | NS5A | NS5A | NS5A |
|---|---|---|---|---|---|---|
| Nucleotide number† | | | | | | |
| Specific | | 2667 | 4286 | 6749 | 7266 | 7595 |
| H77 abs ref | | 2656 | 4275 | 6738 | 7255 | 7584 |
| Plasmid seq | | T | A | T | A | G |
| Construct | Passage | | | | | |
| J6/JFH1(TN-NS5A) | 1st, day8 | | | | | |
| J6/JFH1(TN-NS5A) | 1st, day15 | | | | | |

TABLE 5-continued

| HCV gene | p7 | NS3 | NS5A | NS5A | NS5A |
|---|---|---|---|---|---|
| J6/JFH1(TN-NS5A)$_{2667}$ 1st, day8 | C | G | T/C | T | G/A |

| Amino acid | | | | | |
|---|---|---|---|---|---|
| Specific | 776 | 1316 | 2137 | 2309 | 2419 |
| H77 abs ref | 772 | 1312 | 2133 | 2305 | 2415 |
| Change | F > S | I > V | F > L | D > V | E > K |

TABLE 6

| HCV gene | | NS2 | NS3 | NS5A | NS5A | NS5A | NS5A | NS5A | NS5A | NS5A | NS5A | NS5B |
|---|---|---|---|---|---|---|---|---|---|---|---|---|
| Nucleotide number† | | | | | | | | | | | | |
| Specific | | 2952 | 3905 | 6504 | 6978 | 6992 | 7001 | 7002 | 7005 | 7023 | 7308 | 7844 |
| H77 abs ref | | 2941 | 3894 | 6493 | 6967 | 6981 | 6990 | 6991 | 6994 | 7012 | 7297 | 7836 |
| Plasmid seq | | G | T | C | C | A | A | C | A | C | C | A |
| Construct | Passage | | | | | | | | | | | |
| J6/JFH1(J4-NS5A) | 1st, day13 | G/A | A/t | | | | | | | | | |
| J6JFH1(J4-NS5A)3905 | 1st, day8 | | A | | | | | | | | | |
| J6JFH1(J4-NS5A)2952/3905 | 1st, day8 | A | A | T | | | | | | | C/T | G |
| J6JFH1(J4-NS5A)2952/3905 | 1st, day8 | A | A | | | | | | | | | |
| J6/JFH1(J4-NS5A)$_{2952/3905,ISDRmut}$ | 1st, day8 | A | A | | T | G | G | G | G | G | T | |

| Amino acid | | | | | | | | | | | |
|---|---|---|---|---|---|---|---|---|---|---|---|
| Specific | 871 | 1189 | 2055 | 2213 | 2218 | 2221 | 2222 | 2228 | 2323 | 2502 |
| H77 abs ref | 867 | 1185 | 2051 | 2209 | 2214 | 2217 | 2218 | 2224 | 2319 | 2499 |
| Change | R > H | C > S | T > I | P > L | T > A | | T > G | H > R | A > V | T > I | S > G |

TABLE 7

| HCV gene | p7 | NS5A |
|---|---|---|
| Nucleotide number† | | |
| Specific | 2667 | 7334 |
| H77 abs ref | 2656 | 7335 |
| Plasmid seq | T | A |
| Construct | Passage | | |
| J6/JFH1(J6-NS5A) | 1st, day14 | T/C | |
| J6/JFH1(J6-NS5A)$_{2667}$ | 1st, day10 | C | A/G |

| Amino acid | | |
|---|---|---|
| Specific | 776 | 2332 |
| H77 abs ref | 772 | 2332 |
| Change | F > S | T > A |

TABLE 8

| HCV gene | p7 | NS3 | NS3 | NS5A | NS5A |
|---|---|---|---|---|---|
| Nucleotide number† | | | | | |
| Specific | 2693 | 3473 | 4862 | 6276 | 7580 |
| H77 abs ref | 2682 | 3462 | 4851 | 6265 | 7554 |
| Plasmid seq | C | G | A | A | T |
| Construct | Passage | | | | |
| J6/JFH1(S52-NS5A) | 1st, day14 | C/G | G/A | A/C | A/G | C |
| J6/JFH1(S52-NS5A)$_{6276}$ | 1st, day8 | | | | G | |

TABLE 8-continued

| HCV gene | | p7 | NS3 | NS3 | NS5A | NS5A |
|---|---|---|---|---|---|---|
| J6/JFH1(S52-NS5A)$_{2693/6276}$ | 1st, day8 | G | | | G | |
| J6/JFH1(S52-NS5A)$_{2693/4862/6276/7580}$ | 1st, day8 | G | | C | G | C |
| Amino acid | | | | | | |
| Specific | | 785 | 1045 | 1508 | 1979 | 2414 |
| H77 abs ref | | 781 | 1041 | 1504 | 1975 | 2405 |
| Change | | R > G | G > S | T > P | D > G | W > R |

TABLE 9a

| HCV gene | | E1 | p7 | p7 | NS2 | NS2 | NS2 | NS3 | NS3 | NS4B | NS5A | NS5A | NS5B |
|---|---|---|---|---|---|---|---|---|---|---|---|---|---|
| Nucleotide number† | | | | | | | | | | | | | |
| Specific | | 1170 | 2667 | 2682 | 2850 | 2948 | 3050 | 4101 | 5282 | 6185 | 7143 | 7587 | 8691 |
| H77 abs ref | | 1171 | 2656 | 2671 | 2839 | 2937 | 3029 | 4090 | 5271 | 6174 | 7141 | 7585 | 8689 |
| Plasmid seq | | T | T | A | G | G | T | A | T | A | A | A | T |
| Construct | Passage | | | | | | | | | | | | |
| J6/JFH1(ED43-NS5A) | 1st, day 22 | | | | G/T | G/A | | C | A/G | | G | | |
| J6/JFH1(ED43-NS5A) | 2nd, day 12 | | C/T | | | | | T | C/t | | | | |
| J6/JFH1(ED43-NS5A) | 3rd, day 12 | | C/T | G/a | | | | T/C | | C | G | G | T/C |
| J6/JFH1(ED43-NS5A) | 4th, day 14 | T/C | C/t | | | | | | T/C | | A/G | A/G | |
| J6/JFH1(ED43-NS5A) | 1st, day 12 | | C/T | | | | | | | | | | |
| Amino acid | | | | | | | | | | | | | |
| Specific | | 277 | 776 | 781 | 837 | 870 | 904 | 1254 | 1648 | 1949 | 2268 | 2416 | 2784 |
| H77 abs ref | | 277 | 772 | 777 | 833 | 866 | 896 | 1250 | 1644 | 1945 | 2267 | 2415 | 2783 |
| Change | | V > A | F > S | Y > C | K > N | V > M | Y > H | K > R | Y > H | T > A | E > G | E > G | I > T |

TABLE 9b

| HCV gene | | E2 | p7 | NS2 | NS3 | NS3 | NS3 | NS5A | NS5A | NS5A | NS5A | NS5A | NS5A | NS5A |
|---|---|---|---|---|---|---|---|---|---|---|---|---|---|---|
| Nucleotide number† | | | | | | | | | | | | | | |
| Specific | | 2301 | 2667 | 2930 | 5165 | 5199 | 5282 | 6296 | 6303 | 6335 | 7106 | 7143 | 7170 | 7590 |
| H77 abs ref | | 2290 | 2656 | 2919 | 5154 | 5188 | 5271 | 6285 | 6292 | 6324 | 7107 | 7141 | 7168 | 7588 |
| Plasmid seq | | A | T | T | G | C | T | G | T | C | T | A | G | A |
| Construct | Passage | | | | | | | | | | | | | |
| J6-JFH1 (ED43-NS5A)$_{2667}$ | 1st, day6 | | C | | G/A | C/T | | | | | | | | |
| J6-JFH1 (ED43-NS5A)$_{2667/5282}$ | 1st, day8 | | C | | | | C | A | | | | | | |
| J6-JFH1 (ED43-NS5A)$_{7143}$ | 1st, day8 | C | | A | | | | | A | | | G | | |
| J6-JFH1 (ED43-NS5A)$_{2667/7143}$ | 1st, day8 | | C | | | | | | | C | C | G | A | |
| J6-JFH1 (ED43-NS5A)$_{2667/5282/7143}$ | 1st, day8 | | C | | | | C | | | | | G | | G |

TABLE 9b-continued

| HCV gene | | E2 | p7 | NS2 | NS3 | NS3 | NS3 | NS5A | NS5A | NS5A | NS5A | NS5A | NS5A |
|---|---|---|---|---|---|---|---|---|---|---|---|---|---|
| J6-JFH1 (ED43-NS5A)$_{2667/5282/7143}$ | 1st, day8 | | C | | | C | | | | G | | | |
| Amino acid | | | | | | | | | | | | | |
| Specific | | 654 | 776 | 864 | 1609 | 1620 | 1648 | 1986 | 1988 | 1999 | 2256 | 2268 | 2277 | 2417 |
| H77 abs ref | | 650 | 772 | 860 | 1605 | 1616 | 1644 | 1982 | 1984 | 1995 | 2256 | 2267 | 2276 | 2416 |
| Change | | D > A | F > S | W > R | D > N | P > L | Y > H | D > N | V > A | L > I | F > L | E > G | R > H | D > G |

TABLE 10

| HCV gene | | E2 | E2 | p7 | NS2 | NS3 | NS5A | NS5A | NS5A | NS5A | NS5A | NS5A |
|---|---|---|---|---|---|---|---|---|---|---|---|---|
| Nucleotide number† | | | | | | | | | | | | |
| Specific | | 1674 | 1685 | 2667 | 2865 | 4314 | 6284 | 6689 | 7023 | 7157 | 7278 | 7604 |
| H77 abs ref | | 1675 | 1686 | 2656 | 2854 | 4303 | 6273 | 6678 | 7012 | 7146 | 7267 | 7587 |
| Plasmid seq | | A | T | T | T | T | A | C | C | T | C | A |
| Construct | Passage | | | | | | | | | | | |
| J6/JFH1(SA13-NS5A) | 1st, day6 | G/a | T/G | | | | G | C/T | C/T | | C/T | A/G |
| J6/JFH1(SA13-NS5A)$_{A6284G}$ | 1st, day10 | | | | | | G | | | | | |
| J6/JFH1(SA13-NS5A)$_{A6284G/A7604G}$ | 1st, day10 | | | | | | G | | | | | G |
| J6/JFH1(SA13-NS5A)$_{T2667C/A6284G}$ | 1st, day10 | | | C | C | T/C | G | | | C | | |
| Amino acid | | | | | | | | | | | | |
| Specific | | 445 | 449 | 776 | 842 | 1325 | 1982 | 2117 | 2228 | 2273 | 2313 | 2422 |
| H77 abs ref | | 445 | 449 | 772 | 838 | 1321 | 1978 | 2113 | 2224 | 2269 | 2309 | 2416 |
| Change | | H > R | S > A | F > S | L > P | V > A | R > G | P > S | A > V | S > P | P > L | S > G |

TABLE 11

| HCV gene | | NS4B | NS5A | NS5B |
|---|---|---|---|---|
| Nucleotide number† | | | | |
| Specific | | 5771 | 7155 | 7773 |
| H77 abs ref | | 5760 | 7144 | 7753 |
| Plasmid seq | | A | T | A |
| Construct | Passage | | | |
| J6/JFH1(HK6a-NS5A) | 1st, day 13 | A/G | A | G/A |
| Amino acid | | | | |
| Specific | | 1811 | 2272 | 2478 |
| H77 abs ref | | 1807 | 2268 | 2471 |
| Change | | I > V | I > N | K > R |

TABLE 12

| HCV gene | | E1 | E1 | p7 | p7 | NS3 | NS3 | NS3 | NS5A | NS5B |
|---|---|---|---|---|---|---|---|---|---|---|
| Nucleotide number† | | | | | | | | | | |
| Specific | | 1374 | 1383 | 2610 | 2700 | 3893 | 4080 | 4850 | 6402 | 9073 |
| H77 abs ref | | 1375 | 1384 | 2611 | 2701 | 3894 | 4081 | 4851 | 6403 | 9074 |
| Plasmid seq | | T | T | C | T | T | A | A | G | A |
| Construct | Passage | | | | | | | | | |
| H77/JFH1$_{T2700C,A4080T}$(H77-NS5A) | 1st, day20 | | | T/G | T/C | C | A | T | G/A | A/C |

TABLE 12-continued

| HCV gene | E1 | E1 | p7 | p7 | NS3 | NS3 | NS3 | NS5A | NS5B |
|---|---|---|---|---|---|---|---|---|---|
| H77/JFH1$_{T2700C, A4080T}$(H77-NS5A) 1st, day6 | C | | T | C | A | T | | A/C | |
| H77/JFH1$_{T2700C, A4080T}$(H77-NS5A)3893 1st, day15 | | | | C | | A | T | | |
| Amino acid | | | | | | | | | |
| Specific | 345 | 348 | 757 | 787 | 1185 | 1247 | 1504 | 2021 | 2911 |
| H77 abs ref | 345 | 348 | 757 | 787 | 1185 | 1247 | 1504 | 2021 | 2911 |
| Change | M > T | I > S | A > V | V > A | C > S | Q > L | T > P | G > E | K > N |

TABLE 13

| HCV gene | NS3 | NS3 | NS3 | NS5A |
|---|---|---|---|---|
| Nucleotide number[†] | | | | |
| Specific | 3534 | 4274 | 4562 | 6980 |
| H77 abs ref | 3535 | 4275 | 4563 | 6981 |
| Plasmid seq | T | A | C | A |
| Construct / Passage | | | | |
| TN/JFH1$_{4562}$ (TN-NS5A) 1st, day20 | T/G | | T | |
| TN/JFH1$_{4562}$ (TN-NS5A) 1st, day6 | | A/G | T | A/G |
| Amino acid | | | | |
| Specific | 1065 | 1312 | 1408 | 2214 |
| H77 abs ref | 1065 | 1312 | 1408 | 2214 |
| Change | V > G | I > V | R > W | T > A |

TABLE 15

| HCV gene | p7 | NS3 | NS5A |
|---|---|---|---|
| Nucleotide number[†] | | | |
| Specific | 2718 | 4550 | 7625 |
| H77 abs ref | 2701 | 4533 | 7596 |
| Plasmid seq | T | A | T |
| Construct / Passage | | | |
| S52/JFH1$_{2718, 4550}$ (S52-NS5A) 1st, day14 | G | C | T/C |
| S52/JFH1$_{2718, 4550}$ (S52-NS5A)$_{7625}$ 1st, day10 | G | C | C |
| Amino acid | | | |
| Specific | 793 | 1404 | 2429 |
| H77 abs ref | 787 | 1398 | 2419 |
| Change | I > S | K > Q | C > R |

TABLE 14

| HCV gene | NS2 | NS2 | NS3 | NS3 | NS3 |
|---|---|---|---|---|---|
| Nucleotide number[†] | | | | | |
| Specific | 2996 | 3121 | 3814 | 3893 | 4827 |
| H77 abs ref | 2997 | 3122 | 3815 | 3894 | 4828 |
| Plasmid seq | T | A | T | T | A |
| Construct / Passage | | | | | |
| J4/JFH1$_{2996, 4827}$(J4-NS5A) 1st, day36 | C | | T/G | T/A | T |
| J4/JFH1$_{2996, 4827}$(74-NS5A) 1st, day22 | C | A/C | | T/A | T |
| J4/JFH1$_{2996, 4827}$(34-NS5A)$_{3893}$ 1st, day17 | C | | | A | T |
| Amino acid | | | | | |
| Specific | 886 | 927 | 1158 | 1185 | 1496 |
| H77 abs ref | 886 | 927 | 1158 | 1185 | 1496 |
| Change | F > L | K > N | I > M | C > S | Q > L |

TABLE 16

| HCV gene | | E1 | NS2 | NS2 | NS2 | NS5A | NS5A | NS5A | NS5B |
|---|---|---|---|---|---|---|---|---|---|
| Nucleotide number† | | | | | | | | | |
| Specific | | 1404 | 2819 | 3269 | 3332 | 6291 | 7149 | 7547 | 8019 |
| H77 abs ref | | 1405 | 2820 | 3270 | 3333 | 6292 | 7159 | 7548 | 8029 |
| Plasmid seq | | T | G | T | A | T | A | G | A |
| Construct | Passage | | | | | | | | |
| ED43/JFH1$_{A2819G, A3269T}$ (ED43-NS5A) | 1st, day19 | | G | T | | T/C | | G/C | |
| ED43/JFH1$_{A2819G, A3269T}$ (ED43-NS5A) | 2nd, day12 | | G | T | G | C/t | G/a | C | A/G |
| ED43/JFH1$_{A2819G, A3269T}$ (ED43-NS5A) | 3rd, day14 | C/t | G | T | G | C | G | C | |
| Amino acid | | | | | | | | | |
| Specific | | 355 | 827 | 977 | 998 | 1984 | 2270 | 2403 | 2560 |
| H77 abs ref | | 355 | 827 | 977 | 998 | 1984 | 2273 | 2403 | 2563 |
| Change | | V > A | T > A | T > S | R > G | V > A | E > G | D > H | E > G |

TABLE 17

| HCV gene | | E1 | p7 | NS2 | NS3 | NS3 | NS3 | NS5A | NS5A | NS5A | NS5A | NS5A |
|---|---|---|---|---|---|---|---|---|---|---|---|---|
| Nucleotide number† | | | | | | | | | | | | |
| Specific | | 964 | 2634 | 3405 | 3696 | 3968 | 4537 | 6275 | 7136 | 7347 | 7599 | 7604 |
| H77 abs ref | | 965 | 2632 | 3403 | 3694 | 3966 | 4535 | 6273 | 7134 | 7342 | 7591 | 7596 |
| Plasmid seq | | A | G | C | A | A | A | A | G | T | T | T |
| Construct | Passage | | | | | | | | | | | |
| SA13/JFH1(SA13-NS5A) | transf., day25 | | | | | T | | G | G/T | | | T/C |
| SA13/JFH1$_{C3405G, A3696G}$ (SA13-NS5A) | 1st, day8 | A/G | A/g | G | G | | A/G | G | | T/A | T/A | T/C |
| SA13/JFH1$_{C3405G, A3696G}$ (SA13-NS5A) 6275,7604 | 1st, day6 | | | G | G | | | G | | | | C |
| Amino acid | | | | | | | | | | | | |
| Specific | | 208 | 765 | 1022 | 1119 | 1210 | 1399 | 1979 | 2266 | 2336 | 2420 | 2422 |
| H77 abs ref | | 208 | 764 | 1021 | 1118 | 1209 | 1398 | 1978 | 2265 | 2334 | 2417 | 2419 |
| Change | | N > D | G > E | A > G | K > R | T > S | K > E | R > G | D > Y | V > E | V > E | C > R |

TABLE 18

| HCV gene | | p7 | NS3 | NS3 | NS3 | NS5A | NS5A | NS5A | NS5A | NS5A | NS5A | NS5A |
|---|---|---|---|---|---|---|---|---|---|---|---|---|
| Nucleotide number† | | | | | | | | | | | | |
| Specific | | 2667 | 3458 | 3777 | 4595 | 6257 | 6261 | 6354 | 6677 | 7545 | 7467 | 7559 |
| H77 abs ref | | 2656 | 3447 | 3766 | 4584 | 6246 | 6250 | 6343 | 6666 | 7579 | 7588 | 7593 |
| Plasmid seq | | T | G | C | G | C | T | T | A | A | A | A |
| Construct | Passage | | | | | | | | | | | |
| J6/JFH1(H77-NS5A), d44 | 1st, day 17 | T/C | G/A | T/C | | C/T | T/C | T/C | A/G | | A/G | |
| J6/JFH1(H77-NS5A), d15 | 1st, day 17 | T/C | | T/G | | | | | | A/G | | A/G |
| Amino acid | | | | | | | | | | | | |
| Specific | | 776 | 1040 | 1146 | 1419 | 1973 | 1974 | 2005 | 2113 | 2402 | 2376 | 2407 |
| H77 abs ref | | 772 | 1036 | 1142 | 1415 | 1969 | 1970 | 2001 | 2109 | 2413 | 2416 | 2418 |
| Change | | F > S | T > A | A > V | V > L | P > S | I > T | F > L | N > D | D > G | D > G | V > M |

TABLE 19

| HCV gene | NS2 | NS2 | NS3 | NS3 | NS5A | NS5A | NS5A |
|---|---|---|---|---|---|---|---|
| Nucleotide number† | | | | | | | |
| Specific | 2952 | 2970 | 3896 | 4626 | 6797 | 7356 | 7475 |
| H77 abs ref | 2941 | 2959 | 3885 | 4615 | 6786 | 7345 | 7596 |
| Plasmid seq | G | T | G | T | G | T | T |
| Construct / Passage | | | | | | | |
| J6/JFH1(TN-NS5A), d44 / 1st, day 14 | G/T | | | | G/T | | C |
| J6/JFH1(TN-NS5A), d15 / 1st, day14 | | T/C | T | T/C | | C/t | |

| HCV gene | NS2 | NS2 | NS3 | NS3 | NS5A | NS5A | NS5A |
|---|---|---|---|---|---|---|---|
| Amino acid | | | | | | | |
| Specific | 871 | 877 | 1186 | 1429 | 2153 | 2339 | 2379 |
| H77 abs ref | 867 | 873 | 1182 | 1425 | 2149 | 2335 | 2419 |
| Change | R > L | I > T | A > S | I > T | V > L | L > P | C > R |

TABLE 20

Primers used for amplification of the NS5A region (SEQ ID NO 163-192), amplicon 8-10, according to materials & methods.

| Amplicon | | Genotype | | | | | | |
|---|---|---|---|---|---|---|---|---|
| | | 1a | 1b | 3a | 4a | 5a | 6a | 7a |
| 8 | Forward | 5272S_JFH1 | 5272S_JFH1 | 5272S_JFH1 | 5272S_JFH1 | 5272S_JFH1 | 5272S_JFH1 | 5272S_JFH1 |
| 8 | Reverse | 1aR6686 | 1bR6686 | 3aR6704 | 4aR6730 | SA13R6928 | 6aR6785 | 7aR6650 |
| 9 | Forward | 1aF6276 | 1bF6276 | 3aF6386 | 4aF6489 | SA13F6685 | 6aF6420 | 7aF6498 |
| 9 | Reverse | 1aR7508 | 1bR7508 | 3aR7274 | 4aR7345 | SA13R7597 | 6aR7329 | 7aR7303 |
| 10 | Forward | 1aF7045 | 1bF7045 | 3aF6935 | 4aF7171 | SA13F7129 | 6aF7106 | 7aF7198 |
| 10 | Reverse | 7848R_JFH1 | 7848R_JFH1 | 7848R_JFH1 | 7848R_JFH1 | 7848R_JFH1 | 7848R_JFH1 | 7848R_JFH1 |

TABLE 21

Sensitivity of HCV NS5A genotype 1-7 recombinants to the specific NS5A inhibitor BMS-790052 and to interferon-a.

| NS5A recombinant[A] | | NS5A inhibitor, $EC_{50}$ (nM) (95% CI) | | | Fold resistance | IFN-α, $EC_{50}$ (IU/mL) (95% CI) | |
|---|---|---|---|---|---|---|---|
| Geno-type | Isolate | original | Putative resistance mutant | (Numbering according to NS5A sequence) | compared to original | original | 'Sensitive-type' ISDR mutant |
| 1a | H77C | 0.026 (0.022; 0.031) | Y93H | 110.0 (78.0; 160.0) | 4300 | 0.25 (0.21; 0.29) | — |
| | TN | 0.038 (0.034; 0.043) | — | — | — | 0.28 (0.22; 0.35) | — |
| | DH6 | 0.065 (0.057; 0.074) | — | — | — | — | — |
| | HCV-1 | 0.12 (0.11; 0.14) | — | — | — | — | — |
| | J1 | 1.1 (0.79; 1.6) | — | — | — | — | — |
| 1b | J4 | 0.009 (0.008; 0.009) | Y93H | 0.77 (0.58; 1.0) | 82 | 0.12 (0.09; 0.14) | 0.12 (0.08; 0.16) |
| 2a | JFH1 | 0.097 (0.088; 0.11) | L27I | 0.14 (0.11; 0.19) | 1.6 | 0.25 (0.20; 0.31) | — |
| | | | K30A | 0.034 (0.025; 0.045) | 0.38 | | |
| | | | L31M | 17.0 (12.0; 23.0) | 190 | | |
| | | | I37V | 0.17 (0.13; 0.24) | 2.0 | | |
| | | | C92E | 14.0 (7.8; 27.0) | 170 | | |
| | | | Y93H | 140.0 (110.0; 190.0) | 1600 | | |
| | J6 | 14.0 (11.0; 18.0) | Y93H | 2000.0 (1300; 3100) | 140 | 0.12 (0.08; 0.17) | — |
| | J6 (domain I) | 19.0 (12.0; 28.0) | — | — | — | — | — |
| 3a | S52 | 0.90 (0.75; 1.1) | Y93H | 1900.0 (1200; 3200) | 2100 | 0.27 (0.15; 0.48) | — |
| 4a | ED43 | 0.017 (0.015; 0.020) | Y93H | 0.53 (0.45; 0.63) | 30 | 0.15 (0.10; 0.22) | — |
| 5a | SA13 | 0.034 (0.028; 0.041) | T93H | 0.14 (0.11; 0.19) | 4.2 | 0.32 (0.24; 0.44) | — |
| 6a | HK6a | 0.031 (0.024; 0.041) | T93H | 0.14 (0.11; 0.17) | 4.3 | 0.21 (0.15; 0.29) | — |
| 7a | QC69 | 0.050 (0.037; 0.067) | — | — | — | 0.18 (0.13; 0.26) | — |

[A]Values are means of at least two independent experiments each with three replicates, except for J6/JFH1 mutants L27I, K30A, L31M, I37V, C92E and J6 domain I tested in a single experiment of three replicates.
CI: confidence interval.

REFERENCES

Altschul et al. 1990
J. Bukh et al., Proc Natl Acad Sci USA 99, 14416 (2002).
K. J. Blight, A. A. Kolykhalov, C. M. Rice, Science 290, 1972 (2000).
N. Enomoto et al., N. Engl. J. Med. 334, 77 (1996).
J. M. Gottwein et al., Gastroenterology 133, 1614 (2007).
J. M. Gottwein, J. Bukh, Adv Virus Res 71, 51 (2008).
Gottwein et al. 2009
Jensen et al. 2008
Kato et al., 2001
Kato et al., 2003
Lindenbach et al., 2005
Murphy et al., 2007
A. Sakai et al., J. Virol. 81, 7208 (2007).
Scheel et al. 2008,
U. Schmitz, S. L. Tan, Recent Pat Antiinfect. Drug Discov. 3, 77 (2008).
(Wakita et al., 2005)
M. Yanagi, R. H. Purcell, S. U. Emerson, J. Bukh, Proc Natl Acad Sci USA 94, 8738 (1997.)
M. Yanagi et al., Virology 244, 161 (1998).
M. Yanagi, R. H. Purcell, S. U. Emerson, J. Bukh, Virology 262, 250 (1999).

SEQUENCE LISTING (200 sequences)

SEQ ID NO: 1 - DNA, 9624 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggttcctggctaagggacatctgggactggatatgcgaggtgctgagcgactttaagacctggctgaaagccaagctcatgccacaactgcctgggattccctttgtgtcctgccagcgcgggtataggggggtctggcgaggagacggcattatgcacactcgctgccactgtggagctgagatcactggacatgtcaaaaacgggacgatgaggatcgtcggtcctaggacctgcaggaacatgtggagtgggacgttccccattaacgcctacaccacgggcccctgtactccccttcctgcgccgaactataagttcgcgctgtggagggtgtctgcagaggaatacgtggagataaggcgggtgggggacttccactacgtatcgggtatgactactgacaatcttaaatgcccgtgccagatcccatcgcccgaatttttcacagaattggacggggtgcgcctacacaggtttgcgcccccttgcaagcccttgctgcgggaggaggtatcattcagagtaggactccacgagtacccggtggggtcgcaattaccttgcgagcccgaaccggacgtagccgtgttgacgtccatgctcactgatccctcccatataacagcagaggcggccgggagaaggttggcgagagggtcacccccttctatggccagctcctcggctagccagctgtccgctccatctctcaaggcaacttgcaccgccaaccatgactcccctgacgccgagctcatagaggctaacctcctgtggaggcaggagatgggcggcaacatcaccagggttgagtcagagaacaaagtggtgattctggactccttcgatccgcttgtggcagaggaggatgagcgggaggtctccgtacctgcagaaattctgcggaagtctcggagattcgcccgggccctgcccgtctgggcgcggccggactacaaccccccgctagtagagacgtggaaaaagcctgactacgaaccacctgtggtccatggctgcccgctaccacctccacggtcccctcctgtgcctccgcctcggaaaaagcgtacggtggtcctcaccgaatcaaccctatctactgccttggccgagcttgccaccaaaagttttggcagctcctcaacttccggcattacgggcgacaatacgacaacatcctctgagcccgccccttctggctgcccccccgactccgacgttgagtcctattcttccatgccccccctggagggggagcctggggatccggatctcagcgacgggtcatggtcgacggtcagtagtggggccgacacggaagatgtcgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 2 - DNA, 9624 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatcttttccgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggttcctggctaagggacatctgggactggatatgcgaggtgctgagcgactttaagacctggctgaaagccaagctcatgccacaactgcctgggattccctttgtgtcctgccagcgcgggtataggggggtctggcgaggagacggcattatgcacactcgctgccactgtggagctgagatcactggacatgtcaaaaacgggacgatgaggatcgtcggtcctaggacctgcaggaacatgtggagtgggacgttccccattaacgcctacaccacgggcccctgtactccccttcctgcgccgaactataagttcgcgctgtggagggtgtctgcagaggaatacgtggagataaggcgggtgggggacttccactacgtatcgggtatgactactgacaatcttaaatgcccgtgccagatcccatcgcccgaatttttcacagaattggacggggtgcgcctacacaggtttgcgcccccttgcaagcccttgctgcgggaggaggtatcattcagagtaggactccacgagtacccggtggggtcgcaattaccttgcgagcccgaaccggacgtagccgtgttgacgtccatgctcactgatccctcccatataacagcagaggcggccgggagaaggttggcgagagggtcacccccttctatggccagctcctcggctagccagctgtccgctccatctctcaaggcaacttgcaccgccaaccatgactcccctgacgccgagctcatagaggctaacctcctgtggaggcaggagatgggcggcaacatcaccagggttgagtcagagaacaaagtggtgattctggactccttcgatccgcttgtggcagaggaggatgagcgggaggtctccgtacctgcagaaattctgcggaagtctcggagattcgcccgggccctgcccgtctgggcgcggccggactacaaccccccgctagtagagacgtggaaaaagcctgactacgaaccacctgtggtccatggctgcccgctaccacctccacggtcccctcctgtgcctccgcctcggaaaaagcgtacggtggtcctcaccgaatcaaccctatctactgccttggccgagcttgccaccaaaagttttggcagctcctcaacttccggcattacgggcgacaatacgacaacatcctctgagcccgccccttctggctgcccccccgactccgacgttgagtcctattcttccatgccccccctggagggggagcctggggatccggatctcagcgacgggtcatggtcgacggtcagtagtggggccgacacggaagatgtcgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 3 - DNA, 9624 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggttcctggctgagggacatctgggactggatatgcgaggtgctgagcgactttaagacctggctgaaagccaagctcatgccgcaactgcctgggattccctttgtgtcctgccagcgtgggtataagggggtctggcgaggggacggcatcatgcacactcgctgccactgtggagctgagataactggacatgtcaaaaacgggacgatgaggatcgttggtcctaagacttgcaggaacatgtggagtgggactttccccattaacgcctacaccacgggcccctgtactccccttcctgcgccgaactatacgttcgcgctgtggagggtgtctgcagaggaatacgtggagataaggcaggtgggggacttccactacgtgacgggtatgactactgacaaccttaaatgcccgtgccaggtcccatcgcccgaatttttcacagaattggacggggtgcgcctacataggtttgcgcccccttgcaagcccctgctgcgggaggaggtgtcattcagagtgggactccacgagtacccggtggggtcgcaattaccttgcgagcccgaaccggacgtggccgtgttgacgtccatgctcactgatccctcccatataacagcagaggcggccgggagaaggttggcgaggggatcacccccctctatggccagctcctcggctagccaactgtccgctccatctctcagggcaacttgcactaccaaccatgactcccctgatgctgagctcatagaggccaacctcctatggaggcaggagatgggcggcaacatcaccagggttgagtcagagaacaaagtggtgattctggactccttcgatccgcttgtggcagaggaggatgagcgggaggtctccgtgcccgcagagatactgcggaagtctcggaaattcaccccagccctacccatttgggcgcggccggactataaccccccgctggtggagccgtggaaaaagcctgactacgaaccacctgtggtccatggctgcccgcttccacctccacagtcccctcctgtgcctccacctcggaagaagcggacggtgatcctcaccgaatcaaccctacctactgccttggccgagcttgccaccaaaagttttggcagctcctcaacttccggcattacgggcgacgacacgacaacatcccctgagcccgcctcctctagctgccctcccgactccgacgctgagtcctattcttccatgccccctctggagggggagcctggggatccggatctcagcgacgggtcatggtcgacggtcagtagtgaggccgacaaggaggatgtcgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 4 - DNA, 9624 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatcttttccgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggttcctggctgagggacatctgggactggatatgcgaggtgctgagcgactttaagacctggctgaaagccaagctcatgccgcaactgcctgggattccctttgtgtcctgccagcgtgggtataagggggtctggcgaggggacggcatcatgcacactcgctgccactgtggagctgagataactggacatgtcaaaaacgggacgatgaggatcgttggtcctaagacttgcaggaacatgtggagtgggactttccccattaacgcctacaccacgggcccctgtactccccttcctgcgccgaactatacgttcgcgctgtggagggtgtctgcagaggaatacgtggagataaggcaggtgggggacttccactacgtgacgggtatgactactgacaaccttaaatgcccgtgccaggtcccatcgcccgaatttttcacagaattggacggggtgcgcctacataggtttgcgcccccttgcaagcccctgctgcgggaggaggtgtcattcagagtgggactccacgagtacccggtggggtcgcaattaccttgcgagcccgaaccggacgtggccgtgttgacgtccatgctcactgatccctcccatataacagcagaggcggccgggagaaggttggcgaggggatcacccccctctatggccagctcctcggctagccaactgtccgctccatctctcagggcaacttgcactaccaaccatgactcccctgatgctgagctcatagaggccaacctcctatggaggcaggagatgggcggcaacatcaccagggttgagtcagagaacaaagtggtgattctggactccttcgatccgcttgtggcagaggaggatgagcgggaggtctccgtgcccgcagagatactgcggaagtctcggaaattcaccccagccctacccatttgggcgcggccggactataaccccccgctggtggagccgtggaaaaagcctgactacgaaccacctgtggtccatggctgcccgcttccacctccacagtcccctcctgtgcctccacctcggaagaagcggacggtgatcctcaccgaatcaaccctacctactgccttggccgagcttgccaccaaaagttttggcagctcctcaacttccggcattacgggcgacgacacgacaacatcccctgagcccgcctcctctagctgccctcccgactccgacgctgagtcctattcttccatgccccctctggagggggagcctggggatccggatctcagcgacgggtcatggtcgacggtcagtagtgaggccgacaaggaggatgtcgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 5 - DNA, 9621 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggctcgtggctaagggatgtttgggattggatatgcacggtgttgactgacttcaagacctggctccagtccaaactcctgccgcggttaccgggagtccctttcctgtcatgccaacgcgggtacaagggagtctggcggggggacggcatcatgcaaaccacctgcccatgcggagcacagatcgccggacatgtcaaaaacggttccatgaggatcgtagggcctagaacctgcagcaacacgtggcacggaacgttccccatcaacgcatacaccacgggaccttgcacaccctccccggcgcccaactattccagggcgctatggcgggtggctgctgaggagtacgtggaggttacgcgtgtgggggatttccactacgtgacgggcatgaccactgacaacgtaaagtgcccatgccaggttccggcccccgaattcttcacggaggtggatggagtgcggttgcacaggtacgctccggcgtgcaaacctcttctacgggaggacgtcacgttccaggtcgggctcaaccaatacttggtcgggtcgcagctcccatgcgagcccgaaccggacgtaacagtgcttacttccatgctcaccgatccctcccacattacagcagagacggctaagcgtaggctggctagagggtctcccccctctttagccagctcatcagctagccagttgtctgcgccttctttgaaggcgacatgcactacccaccatgactccccggacgctgacctcatcgaggccaacctcttgtggcggcaggagatgggcggaaacatcactcgcgtggagtcagagaataaggtagtaattctggactctttcgaaccgcttcacgcggagggggatgagagggagatatccgtcgcggcggagatcctgcgaaaatccaggaagttcccctcagcgttgcccatatgggcacgcccggactacaatcctccactgctagagtcctggaaggacccggactacgtccctccggtggtacacggatgcccattgccacctaccaaggctcctccaataccacctccacggagaaagaggacggttgtcctgacagaatccaatgtgtcttctgccttggcggagctcgccactaagaccttcggtagctccggatcgtcggccgttgatagcggcacggcgaccgcccttcctgacctggcctccgacgacggtgacaaaggatccgacgttgagtcgtactcctccatgcccccccttgaaggggagccgggggaccccgatctcagcgacgggtcttggtctaccgtgagtgaggaggctagtgaggatgtcgtctgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 6 - DNA, 9621 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatcttttccgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggctcgtggctaagggatgtttgggattggatatgcacggtgttgactgacttcaagacctggctccagtccaaactcctgccgcggttaccgggagtccctttcctgtcatgccaacgcgggtacaagggagtctggcggggggacggcatcatgcaaaccacctgcccatgcggagcacagatcgccggacatgtcaaaaacggttccatgaggatcgtagggcctagaacctgcagcaacacgtggcacggaacgttccccatcaacgcatacaccacgggaccttgcacaccctccccggcgcccaactattccagggcgctatggcgggtggctgctgaggagtacgtggaggttacgcgtgtgggggatttccactacgtgacgggcatgaccactgacaacgtaaagtgcccatgccaggttccggcccccgaattcttcacggaggtggatggagtgcggttgcacaggtacgctccggcgtgcaaacctcttctacgggaggacgtcacgttccaggtcgggctcaaccaatacttggtcgggtcgcagctcccatgcgagcccgaaccggacgtaacagtgcttacttccatgctcaccgatccctcccacattacagcagagacggctaagcgtaggctggctagagggtctcccccctctttagccagctcatcagctagccagttgtctgcgccttctttgaaggcgacatgcactacccaccatgactccccggacgctgacctcatcgaggccaacctcttgtggcggcaggagatgggcggaaacatcactcgcgtggagtcagagaataaggtagtaattctggactctttcgaaccgcttcacgcggagggggatgagagggagatatccgtcgcggcggagatcctgcgaaaatccaggaagttcccctcagcgttgcccatatgggcacgcccggactacaatcctccactgctagagtcctggaaggacccggactacgtccctccggtggtacacggatgcccattgccacctaccaaggctcctccaataccacctccacggagaaagaggacggttgtcctgacagaatccaatgtgtcttctgccttggcggagctcgccactaagaccttcggtagctccggatcgtcggccgttgatagcggcacggcgaccgcccttcctgacctggcctccgacgacggtgacaaaggatccgacgttgagtcgtactcctccatgcccccccttgaaggggagccgggggaccccgatctcagcgacgggtcttggtctaccgtgagtgaggaggctagtgaggatgtcgtctgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 7 - DNA, 9621 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcacggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggctcgtggctaagggatgtttgggattggatatgcacggtgttgactgacttcaagacctggctccagtccaaactcctgccgcggttaccgggagtccctttcctgtcatgccaacgcgggtacaagggagtctggcggggggacggcatcatgcaaaccacctgcccatgcggagcacagatcgccggacatgtcaaaaacggttccatgaggatcgtagggcctagaacctgcagcaacacgtggcacggaacgttccccatcaacgcatacaccacgggaccttgcacaccctccccggcgcccaactattccagggcgctatggcgggtggctgctgaggagtacgtggaggttacgcgtgtgggggatttccactacgtgacgggcatgaccactgacaacgtaaagtgcccatgccaggttccggcccccgaattcttcacggaggtggatggagtgcggttgcacaggtacgctccggcgtgcaaacctcttctacgggaggacgtcacgttccaggtcgggctcaaccaatacttggtcgggtcgcagctcccatgcgagcccgaaccggacgtaacagtgcttacttccatgctcaccgatccctcccacattacagcagagacggctaagcgtaggctggctagagggtctcccccctctttagccagctcatcagctagccagttgtctgcgccttctttgaaggcgacatgcactacccaccatgactccccggacgctgacctcatcgaggccaacctcttgtggcggcaggagatgggcggaaacatcactcgcgtggagtcagagaataaggtagtaattctggactctttcgaaccgcttcacgcggagggggatgagagggagatatccgtcgcggcggagatcctgcgaaaatccaggaagttcccctcagcgttgcccatatgggcacgcccggactacaatcctccactgctagagtcctggaaggacccggactacgtccctccggtggtacacggatgcccattgccacctaccaaggctcctccaataccacctccacggagaaagaggacggttgtcctgacagaatccaatgtgtcttctgccttggcggagctcgccactaagaccttcggtagctccggatcgtcggccgttgatagcggcacggcgaccgcccttcctgacctggcctccgacgacggtgacaaaggatccgacgttgagtcgtactcctccatgcccccccttgaaggggagccgggggaccccgatctcagcgacgggtcttggtctaccgtgagtgaggaggctagtgaggatgtcgtctgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 8 - DNA, 9621 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgagctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggctcgtggctaagggatgtttgggattggatatgcacggtgttgactgacttcaagacctggctccagtccaaactcctgccgcggttaccgggagtccctttcctgtcatgccaacgcgggtacaagggagtctggcggggggacggcatcatgcaaaccacctgcccatgcggagcacagatcgccggacatgtcaaaaacggttccatgaggatcgtagggcctagaacctgcagcaacacgtggcacggaacgttccccatcaacgcatacaccacgggaccttgcacaccctccccggcgcccaactattccagggcgctatggcgggtggctgctgaggagtacgtggaggttacgcgtgtgggggatttccactacgtgacgggcatgaccactgacaacgtaaagtgcccatgccaggttccggcccccgaattcttcacggaggtggatggagtgcggttgcacaggtacgctccggcgtgcaaacctcttctacgggaggacgtcacgttccaggtcgggctcaaccaatacttggtcgggtcgcagctcccatgcgagcccgaaccggacgtaacagtgcttacttccatgctcaccgatccctcccacattacagcagagacggctaagcgtaggctggctagagggtctcccccctctttagccagctcatcagctagccagttgtctgcgccttctttgaaggcgacatgcactacccaccatgactccccggacgctgacctcatcgaggccaacctcttgtggcggcaggagatgggcggaaacatcactcgcgtggagtcagagaataaggtagtaattctggactctttcgaaccgcttcacgcggagggggatgagagggagatatccgtcgcggcggagatcctgcgaaaatccaggaagttcccctcagcgttgcccatatgggcacgcccggactacaatcctccactgctagagtcctggaaggacccggactacgtccctccggtggtacacggatgcccattgccacctaccaaggctcctccaataccacctccacggagaaagaggacggttgtcctgacagaatccaatgtgtcttctgccttggcggagctcgccactaagaccttcggtagctccggatcgtcggccgttgatagcggcacggcgaccgcccttcctgacctggcctccgacgacggtgacaaaggatccgacgttgagtcgtactcctccatgcccccccttgaaggggagccgggggaccccgatctcagcgacgggtcttggtctaccgtgagtgaggaggctagtgaggatgtcgtctgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 9 - DNA, 9621 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcacggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgagctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggctcgtggctaagggatgtttgggattggatatgcacggtgttgactgacttcaagacctggctccagtccaaactcctgccgcggttaccgggagtccctttcctgtcatgccaacgcgggtacaagggagtctggcggggggacggcatcatgcaaaccacctgcccatgcggagcacagatcgccggacatgtcaaaaacggttccatgaggatcgtagggcctagaacctgcagcaacacgtggcacggaacgttccccatcaacgcatacaccacgggaccttgcacaccctccccggcgcccaactattccagggcgctatggcgggtggctgctgaggagtacgtggaggttacgcgtgtgggggatttccactacgtgacgggcatgaccactgacaacgtaaagtgcccatgccaggttccggcccccgaattcttcacggaggtggatggagtgcggttgcacaggtacgctccggcgtgcaaacctcttctacgggaggacgtcacgttccaggtcgggctcaaccaatacttggtcgggtcgcagctcccatgcgagcccgaaccggacgtaacagtgcttacttccatgctcaccgatccctcccacattacagcagagacggctaagcgtaggctggctagagggtctcccccctctttagccagctcatcagctagccagttgtctgcgccttctttgaaggcgacatgcactacccaccatgactccccggacgctgacctcatcgaggccaacctcttgtggcggcaggagatgggcggaaacatcactcgcgtggagtcagagaataaggtagtaattctggactctttcgaaccgcttcacgcggagggggatgagagggagatatccgtcgcggcggagatcctgcgaaaatccaggaagttcccctcagcgttgcccatatgggcacgcccggactacaatcctccactgctagagtcctggaaggacccggactacgtccctccggtggtacacggatgcccattgccacctaccaaggctcctccaataccacctccacggagaaagaggacggttgtcctgacagaatccaatgtgtcttctgccttggcggagctcgccactaagaccttcggtagctccggatcgtcggccgttgatagcggcacggcgaccgcccttcctgacctggcctccgacgacggtgacaaaggatccgacgttgagtcgtactcctccatgcccccccttgaaggggagccgggggaccccgatctcagcgacgggtcttggtctaccgtgagtgaggaggctagtgaggatgtcgtctgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 10 - DNA, 9621 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcacggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgagctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggctcgtggctaagggatgtttgggattggatatgcacggtgttgactgacttcaagacctggctccagtccaaactcctgccgcggttaccgggagtccctttcctgtcatgccaacgcgggtacaagggagtctggcggggggacggcatcatgcaaaccacctgcccatgcggagcacagatcgccggacatgtcaaaaacggttccatgaggatcgtagggcctagaacctgcagcaacacgtggcacggaacgttccccatcaacgcatacaccacgggaccttgcacaccctccccggcgcccaactattccagggcgctatggcgggtggctgctgaggagtacgtggaggttacgcgtgtgggggatttccactacgtgacgggcatgaccactgacaacgtaaagtgcccatgccaggttccggcccccgaattcttcacggaggtggatggagtgcggttgcacaggtacgctccggcgtgcaaacctcttctacgggaggacgtcacgttccaggtcgggctcaaccaatacttggtcgggtcgcagctcccatgcgagcccgaaccggacgtaacagtgcttacttccatgctcaccgatccctcccacattacagcagagacggctaagcgtaggctggctagagggtctcccccctctttagccagctcatcagctagccagttgtctgcgctttctttgaaggcggcatgcactggccgccatgactccccggacgttgacctcatcgaggccaacctcttgtggcggcaggagatgggcggaaacatcactcgcgtggagtcagagaataaggtagtaattctggactctttcgaaccgcttcacgcggagggggatgagagggagatatccgtcgcggcggagatcctgcgaaaatccaggaagttcccctcagcgttgcccatatgggcacgcccggactacaatcctccactgctagagtcctggaaggacccggactacgtccctccggtggtacacggatgcccattgccacctaccaaggctcctccaataccacctccacggagaaagaggacggttgtcctgacagaatccaatgtgtcttctgccttggcggagctcgccactaagaccttcggtagctccggatcgtcggccgttgatagcggcacggcgaccgcccttcctgacctggcctccgacgacggtgacaaaggatccgacgttgagtcgtactcctccatgcccccccttgaaggggagccgggggaccccgatctcagcgacgggtcttggtctaccgtgagtgaggaggctagtgaggatgtcgtctgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 11 - DNA, 9678 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgcggcggctcgtggctccgcgatgtgtgggactgggtttgcaccatcctaacagactttaaaaattggctgacctccaaattattcccaaagatgcccggcctcccctttgtctcctgtcaaaaggggtacaagggcgtgtgggccggcactggcatcatgaccacacggtgtccttgcggcgccaatatctctggcaatgtccgcttgggctccatgagaatcacggggcctaagacctgcatgaatatctggcaggggacctttcctatcaattgttacacggagggccagtgcgtgccgaaacccgcgccaaactttaaggtcgccatctggagggtggcggcctcagagtacgcggaggtgacgcagcacgggtcataccactacataacaggactcaccactgataacttgaaagtcccctgccaactaccctctcccgagttcttttcctgggtggacggagtgcagatccataggtttgcccccacaccgaagccgtttttccgggatgaggtctcgttctgcgttgggcttaattcatttgtcgtcgggtcccagcttccttgcgaccctgaacccgacacagacgtattgatgtccatgctaacagatccatctcatatcacggcggagactgcagcgcggcgtttagcgcgggggtcacccccatccgaggcaagctcctcggcgagccagctatcggcaccatcgctgcgagccacctgcaccacccacggcaaagcctatgatgtggacatggtggatgctaacctgttcatggggggcgatgtgactcggatagagtctgggtccaaagtggtcgttctggactctctcgacccaatggtcgaagaaaggagcgaccttgagccttcgataccatcagaatacatgctccccaagaagaggttcccaccagctttaccggcctgggcacggcctgattacaacccaccgcttgtggaatcgtggaaaaggccagattaccaaccggccactgttgcgggctgtgctctccctcctcctaggaaaaccccgacgcctcccccaaggaggcgccggacagtgggcctaagtgaggactccataggagatgcccttcaacagctggccattaagtcctttggccagccccccccaagcggcgattcaggcctttccacgggggcgggcgctgccgattccggcagtcagacgcctcctgatgagttggccctttcggagacaggttccatctcttccatgccccccctcgagggggagcttggagatccagacctggagcctgagcaggtagagccccaaccccccccccaggggggggtggcagctcccggctcggactcggggtcctggtctacttgctccgaggaggacgactccgtcgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 12 - DNA, 9678 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatcttttccgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgcggcggctcgtggctccgcgatgtgtgggactgggtttgcaccatcctaacagactttaaaaattggctgacctccaaattattcccaaagatgcccggcctcccctttgtctcctgtcaaaaggggtacaagggcgtgtgggccggcactggcatcatgaccacacggtgtccttgcggcgccaatatctctggcaatgtccgcttgggctccatgagaatcacggggcctaagacctgcatgaatatctggcaggggacctttcctatcaattgttacacggagggccagtgcgtgccgaaacccgcgccaaactttaaggtcgccatctggagggtggcggcctcagagtacgcggaggtgacgcagcacgggtcataccactacataacaggactcaccactgataacttgaaagtcccctgccaactaccctctcccgagttcttttcctgggtggacggagtgcagatccataggtttgcccccacaccgaagccgtttttccgggatgaggtctcgttctgcgttgggcttaattcatttgtcgtcgggtcccagcttccttgcgaccctgaacccgacacagacgtattgatgtccatgctaacagatccatctcatatcacggcggagactgcagcgcggcgtttagcgcgggggtcacccccatccgaggcaagctcctcggcgagccagctatcggcaccatcgctgcgagccacctgcaccacccacggcaaagcctatgatgtggacatggtggatgctaacctgttcatggggggcgatgtgactcggatagagtctgggtccaaagtggtcgttctggactctctcgacccaatggtcgaagaaaggagcgaccttgagccttcgataccatcagaatacatgctccccaagaagaggttcccaccagctttaccggcctgggcacggcctgattacaacccaccgcttgtggaatcgtggaaaaggccagattaccaaccggccactgttgcgggctgtgctctccctcctcctaggaaaaccccgacgcctcccccaaggaggcgccggacagtgggcctaagtgaggactccataggagatgcccttcaacagctggccattaagtcctttggccagccccccccaagcggcgattcaggcctttccacgggggcgggcgctgccgattccggcagtcagacgcctcctgatgagttggccctttcggagacaggttccatctcttccatgccccccctcgagggggagcttggagatccagacctggagcctgagcaggtagagccccaaccccccccccaggggggggtggcagctcccggctcggactcggggtcctggtctacttgctccgaggaggacgactccgtcgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 13 - DNA, 9636 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgcagcggcgattggctgcgtgacatctgggactgggtttgctcggtgttgtccgacttcaagacgtggctctctgctaagattatgccagcactccctgggctgcccttcatctcctgtcaaaagggatacaagggcgtgtggcggggggatggtgtgatgtcgacacgctgtccttgcggggcatcaatcactggccacgtgaagaatgggtccatgcggcttgcggggccgcgtatgtgtgctaacatgtggcacggtactttccccatcaatgagtacaccaccggacccagcacaccttgcccatcacccaactacactcgcgcactatggcgcgtggctgccagcagctacgttgaggtgcgccgggtgggggacttccattatattacgggggctacagaagatgagctcaagtgtccgtgccaagtgccggctgctgagttctttactgaagtggatggggtgagactccaccgttacgcccctccatgtaagcccctgttgagagaagagatcactttctcggtagggttgcattcctacgcgataggatctcaactcccctgtgagccagaaccagatgtttctgtgttgacctcgatgttgagagacccttctcatatcaccgccgagacggcagcgcgccgccttgcgcgcgggtcccctccatcagaggcaagctcatccgccagccaactatcggctccgtcgttgaaggccacttgccagacgcataggcctcatccagacgctgagctggtggacgccaacttgttatggcggcaagagatgggcagcaacattacacgggtggagtctgaaacgaaggttgtgattcttgattcattcgaacctctgagagccgaagctgacgacgccgagctctcggtggctgcagagtgtttcaagaagcctcccaagtatcctccagcccttcctatctgggccaggccggactacaaccctccactgttggaccgctggaaagcaccggattatgtaccaccaactgtccatggatgtgccttaccaccacggggcgctccaccggtgcctcctcctcggaggaaaagaacaatccagctggacggctccaatgtgtccgcggcgctagctgcgctagcggaaaaatcattcccgaccccaaaatcgcaggaagagaatagctcatcctctggggtcgacacacagtccagcactacctccaggatgcccccctctccaggaggggagtccgactcagagtcatgctcgtccatgcctcctctcgagggagagccgggcgatccggacttgagttgcgactcttggtccaccgttagtgacaacgaggagcagagcgtggtctgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 14 - DNA, 9636 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatcttttccgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgcagcggcgattggctgcgtgacatctgggactgggtttgctcggtgttgtccgacttcaagacgtggctctctgctaagattatgccagcactccctgggctgcccttcatctcctgtcaaaagggatacaagggcgtgtggcggggggatggtgtgatgtcgacacgctgtccttgcggggcatcaatcactggccacgtgaagaatgggtccatgcggcttgcggggccgcgtatgtgtgctaacatgtggcacggtactttccccatcaatgagtacaccaccggacccagcacaccttgcccatcacccaactacactcgcgcactatggcgcgtggctgccagcagctacgttgaggtgcgccgggtgggggacttccattatattacgggggctacagaagatgagctcaagtgtccgtgccaagtgccggctgctgagttctttactgaagtggatggggtgagactccaccgttacgcccctccatgtaagcccctgttgagagaagagatcactttctcggtagggttgcattcctacgcgataggatctcaactcccctgtgagccagaaccagatgtttctgtgttgacctcgatgttgagagacccttctcatatcaccgccgagacggcagcgcgccgccttgcgcgcgggtcccctccatcagaggcaagctcatccgccagccaactatcggctccgtcgttgaaggccacttgccagacgcataggcctcatccagacgctgagctggtggacgccaacttgttatggcggcaagagatgggcagcaacattacacgggtggagtctgaaacgaaggttgtgattcttgattcattcgaacctctgagagccgaagctgacgacgccgagctctcggtggctgcagagtgtttcaagaagcctcccaagtatcctccagcccttcctatctgggccaggccggactacaaccctccactgttggaccgctggaaagcaccggattatgtaccaccaactgtccatggatgtgccttaccaccacggggcgctccaccggtgcctcctcctcggaggaaaagaacaatccagctggacggctccaatgtgtccgcggcgctagctgcgctagcggaaaaatcattcccgaccccaaaatcgcaggaagagaatagctcatcctctggggtcgacacacagtccagcactacctccaggatgcccccctctccaggaggggagtccgactcagagtcatgctcgtccatgcctcctctcgagggagagccgggcgatccggacttgagttgcgactcttggtccaccgttagtgacaacgaggagcagagcgtggtctgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 15 - DNA, 9636 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtggggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgcagcggcgattggctgcgtgacatctgggactgggtttgctcggtgttgtccgacttcaagacgtggctctctgctaagattatgccagcactccctgggctgcccttcatctcctgtcaaaagggatacaagggcgtgtggcggggggatggtgtgatgtcgacacgctgtccttgcggggcatcaatcactggccacgtgaagaatgggtccatgcggcttgcggggccgcgtatgtgtgctaacatgtggcacggtactttccccatcaatgagtacaccaccggacccagcacaccttgcccatcacccaactacactcgcgcactatggcgcgtggctgccagcagctacgttgaggtgcgccgggtgggggacttccattatattacgggggctacagaagatgagctcaagtgtccgtgccaagtgccggctgctgagttctttactgaagtggatggggtgagactccaccgttacgcccctccatgtaagcccctgttgagagaagagatcactttctcggtagggttgcattcctacgcgataggatctcaactcccctgtgagccagaaccagatgtttctgtgttgacctcgatgttgagagacccttctcatatcaccgccgagacggcagcgcgccgccttgcgcgcgggtcccctccatcagaggcaagctcatccgccagccaactatcggctccgtcgttgaaggccacttgccagacgcataggcctcatccagacgctgagctggtggacgccaacttgttatggcggcaagagatgggcagcaacattacacgggtggagtctgaaacgaaggttgtgattcttgattcattcgaacctctgagagccgaagctgacgacgccgagctctcggtggctgcagagtgtttcaagaagcctcccaagtatcctccagcccttcctatctgggccaggccggactacaaccctccactgttggaccgctggaaagcaccggattatgtaccaccaactgtccatggatgtgccttaccaccacggggcgctccaccggtgcctcctcctcggaggaaaagaacaatccagctggacggctccaatgtgtccgcggcgctagctgcgctagcggaaaaatcattcccgaccccaaaatcgcaggaagagaatagctcatcctctggggtcgacacacagtccagcactacctccaggatgcccccctctccaggaggggagtccgactcagagtcatgctcgtccatgcctcctctcgagggagagccgggcgatccggacttgagttgcgactcttggtccaccgttagtgacaacgaggagcagagcgtggtctgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 16 - DNA, 9636 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgagcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgcagcggcgattggctgcgtgacatctgggactgggtttgctcggtgttgtccgacttcaagacgtggctctctgctaagattatgccagcactccctgggctgcccttcatctcctgtcaaaagggatacaagggcgtgtggcggggggatggtgtgatgtcgacacgctgtccttgcggggcatcaatcactggccacgtgaagaatgggtccatgcggcttgcggggccgcgtatgtgtgctaacatgtggcacggtactttccccatcaatgagtacaccaccggacccagcacaccttgcccatcacccaactacactcgcgcactatggcgcgtggctgccagcagctacgttgaggtgcgccgggtgggggacttccattatattacgggggctacagaagatgagctcaagtgtccgtgccaagtgccggctgctgagttctttactgaagtggatggggtgagactccaccgttacgcccctccatgtaagcccctgttgagagaagagatcactttctcggtagggttgcattcctacgcgataggatctcaactcccctgtgagccagaaccagatgtttctgtgttgacctcgatgttgagagacccttctcatatcaccgccgagacggcagcgcgccgccttgcgcgcgggtcccctccatcagaggcaagctcatccgccagccaactatcggctccgtcgttgaaggccacttgccagacgcataggcctcatccagacgctgagctggtggacgccaacttgttatggcggcaagagatgggcagcaacattacacgggtggagtctgaaacgaaggttgtgattcttgattcattcgaacctctgagagccgaagctgacgacgccgagctctcggtggctgcagagtgtttcaagaagcctcccaagtatcctccagcccttcctatctgggccaggccggactacaaccctccactgttggaccgctggaaagcaccggattatgtaccaccaactgtccatggatgtgccttaccaccacggggcgctccaccggtgcctcctcctcggaggaaaagaacaatccagctggacggctccaatgtgtccgcggcgctagctgcgctagcggaaaaatcattcccgaccccaaaatcgcaggaagagaatagctcatcctctggggtcgacacacagtccagcactacctccaggatgcccccctctccaggaggggagtccgactcagagtcatgctcgtccatgcctcctctcgagggagagccgggcgatccggacttgagttgcgactcttggtccaccgttagtgacaacgaggagcagagcgtggtctgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 17 - DNA, 9636 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttcccctggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgcagcggcgattggctgcgtgacatctgggactgggtttgctcggtgttgtccgacttcaagacgtggctctctgctaagattatgccagcactccctgggctgcccttcatctcctgtcaaaagggatacaagggcgtgtggcggggggatggtgtgatgtcgacacgctgtccttgcggggcatcaatcactggccacgtgaagaatgggtccatgcggcttgcggggccgcgtatgtgtgctaacatgtggcacggtactttccccatcaatgagtacaccaccggacccagcacaccttgcccatcacccaactacactcgcgcactatggcgcgtggctgccagcagctacgttgaggtgcgccgggtgggggacttccattatattacgggggctacagaagatgagctcaagtgtccgtgccaagtgccggctgctgagttctttactgaagtggatggggtgagactccaccgttacgcccctccatgtaagcccctgttgagagaagagatcactttctcggtagggttgcattcctacgcgataggatctcaactcccctgtgagccagaaccagatgtttctgtgttgacctcgatgttgagagacccttctcatatcaccgccgagacggcagcgcgccgccttgcgcgcgggtcccctccatcagaggcaagctcatccgccagccaactatcggctccgtcgttgaaggccacttgccagacgcataggcctcatccagacgctgagctggtggacgccaacttgttatggcggcaagagatgggcagcaacattacacgggtggagtctgaaacgaaggttgtgattcttgattcattcgaacctctgagagccgaagctgacgacgccgagctctcggtggctgcagagtgtttcaagaagcctcccaagtatcctccagcccttcctatctgggccaggccggactacaaccctccactgttggaccgctggaaagcaccggattatgtaccaccaactgtccatggatgtgccttaccaccacggggcgctccaccggtgcctcctcctcggaggaaaagaacaatccagctggacggctccaatgtgtccgcggcgctagctgcgctagcggaaaaatcattcccgaccccaaaatcgcaggaagagaatagctcatcctctggggtcgacacacagtccagcactacctccaggatgcccccctctccaggaggggagtccgactcagagtcatgctcgtccatgcctcctctcgagggagagccgggcgatccggacttgagttgcgactcttggtccaccgttagtgacaacgaggagcagagcgtggtctgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 18 - DNA, 9636 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgcagcggcggttggctgcgtgacatctgggactgggtttgctcggtgttgtccgacttcaagacgtggctctctgctaagattatgccagcactccctgggctgcccttcatctcctgtcaaaagggatacaagggcgtgtggcggggggatggtgtgatgtcgacacgctgtccttgcggggcatcaatcactggccacgtgaagaatgggtccatgcggcttgcggggccgcgtatgtgtgctaacatgtggcacggtactttccccatcaatgagtacaccaccggacccagcacaccttgcccatcacccaactacactcgcgcactatggcgcgtggctgccagcagctacgttgaggtgcgccgggtgggggacttccattatattacgggggctacagaagatgagctcaagtgtccgtgccaagtgccggctgctgagttctttactgaagtggatggggtgagactccaccgttacgcccctccatgtaagcccctgttgagagaagagatcactttctcggtagggttgcattcctacgcgataggatctcaactcccctgtgagccagaaccagatgtttctgtgttgacctcgatgttgagagacccttctcatatcaccgccgagacggcagcgcgccgccttgcgcgcgggtcccctccatcagaggcaagctcatccgccagccaactatcggctccgtcgttgaaggccacttgccagacgcataggcctcatccagacgctgagctggtggacgccaacttgttatggcggcaagagatgggcagcaacattacacgggtggagtctgaaacgaaggttgtgattcttgattcattcgaacctctgagagccgaagctgacgacgccgagctctcggtggctgcagagtgtttcaagaagcctcccaagtatcctccagcccttcctatctgggccaggccggactacaaccctccactgttggaccgctggaaagcaccggattatgtaccaccaactgtccatggatgtgccttaccaccacggggcgctccaccggtgcctcctcctcggaggaaaagaacaatccagctggacggctccaatgtgtccgcggcgctagctgcgctagcggaaaaatcattcccgaccccaaaatcgcaggaagagaatagctcatcctctggggtcgacacacagtccagcactacctccaggatgcccccctctccaggaggggagtccgactcagagtcatgctcgtccatgcctcctctcgagggagagccgggcgatccggacttgagttgcgactcttggtccaccgttagtgacaacgaggagcagagcgtggtctgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 19 - DNA, 9636 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgcagcggcgattggctgcgtgacatctgggactgggtttgctcggtgttgtccgacttcaagacgtggctctctgctaagattatgccagcactccctgggctgcccttcatctcctgtcaaaagggatacaagggcgtgtggcggggggatggtgtgatgtcgacacgctgtccttgcggggcatcaatcactggccacgtgaagaatgggtccatgcggcttgcggggccgcgtatgtgtgctaacatgtggcacggtactttccccatcaatgagtacaccaccggacccagcacaccttgcccatcacccaactacactcgcgcactatggcgcgtggctgccagcagctacgttgaggtgcgccgggtgggggacttccattatattacgggggctacagaagatgagctcaagtgtccgtgccaagtgccggctgctgagttctttactgaagtggatggggtgagactccaccgttacgcccctccatgtaagcccctgttgagagaagagatcactttctcggtagggttgcattcctacgcgataggatctcaactcccctgtgagccagaaccagatgtttctgtgttgacctcgatgttgagagacccttctcatatcaccgccgagacggcagcgcgccgccttgcgcgcgggtcccctccatcagaggcaagctcatccgccagccaactatcggctccgtcgttgaaggccacttgccagacgcataggcctcatccagacgctgagctggtggacgccaacttgttatggcggcaagagatgggcagcaacattacacgggtggagtctgaaacgaaggttgtgattcttgattcattcgaacctctgagagccgaagctgacgacgccgagctctcggtggctgcagagtgtttcaagaagcctcccaagtatcctccagcccttcctatctgggccaggccggactacaaccctccactgttggaccgctggaaagcaccggattatgtaccaccaactgtccatggatgtgccttaccaccacggggcgctccaccggtgcctcctcctcggaggaaaagaacaatccagctggacggctccaatgtgtccgcggcgctagctgcgctagcggaaaaatcattcccgaccccaaaatcgcaggaagagaatagctcatcctctggggtcgacacacagtccagcactacctccaggatgcccccctctccaggaggggagtccgactcagagtcatgctcgtccatgcctcctctcgagggagagccgggcgatccggacttgagttgcgactctcggtccaccgttagtgacaacgaggagcagagcgtggtctgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 20 - DNA, 9636 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtggggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttcccctggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgcagcggcgattggctgcgtgacatctgggactgggtttgctcggtgttgtccgacttcaagacgtggctctctgctaagattatgccagcactccctgggctgcccttcatctcctgtcaaaagggatacaagggcgtgtggcggggggatggtgtgatgtcgacacgctgtccttgcggggcatcaatcactggccacgtgaagaatgggtccatgcggcttgcggggccgcgtatgtgtgctaacatgtggcacggtactttccccatcaatgagtacaccaccggacccagcacaccttgcccatcacccaactacactcgcgcactatggcgcgtggctgccagcagctacgttgaggtgcgccgggtgggggacttccattatattacgggggctacagaagatgagctcaagtgtccgtgccaagtgccggctgctgagttctttactgaagtggatggggtgagactccaccgttacgcccctccatgtaagcccctgttgagagaagagatcactttctcggtagggttgcattcctacgcgataggatctcaactcccctgtgagccagaaccagatgtttctgtgttgacctcgatgttgagagacccttctcatatcaccgccgagacggcagcgcgccgccttgcgcgcgggtcccctccatcagaggcaagctcatccgccagccaactatcggctccgtcgttgaaggccacttgccagacgcataggcctcatccagacgctgagctggtggacgccaacttgttatggcggcaagagatgggcagcaacattacacgggtggagtctgaaacgaaggttgtgattcttgattcattcgaacctctgagagccgaagctgacgacgccgagctctcggtggctgcagagtgtttcaagaagcctcccaagtatcctccagcccttcctatctgggccaggccggactacaaccctccactgttggaccgctggaaagcaccggattatgtaccaccaactgtccatggatgtgccttaccaccacggggcgctccaccggtgcctcctcctcggaggaaaagaacaatccagctggacggctccaatgtgtccgcggcgctagctgcgctagcggaaaaatcattcccgaccccaaaatcgcaggaagagaatagctcatcctctggggtcgacacacagtccagcactacctccaggatgcccccctctccaggaggggagtccgactcagagtcatgctcgtccatgcctcctctcgagggagagccgggcgatccggacttgagttgcgactcttggtccaccgttagtgacaacgaggagcagagcgtggtctgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 21 - DNA, 9636 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtggggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgcagcggcggttggctgcgtgacatctgggactgggtttgctcggtgttgtccgacttcaagacgtggctctctgctaagattatgccagcactccctgggctgcccttcatctcctgtcaaaagggatacaagggcgtgtggcggggggatggtgtgatgtcgacacgctgtccttgcggggcatcaatcactggccacgtgaagaatgggtccatgcggcttgcggggccgcgtatgtgtgctaacatgtggcacggtactttccccatcaatgagtacaccaccggacccagcacaccttgcccatcacccaactacactcgcgcactatggcgcgtggctgccagcagctacgttgaggtgcgccgggtgggggacttccattatattacgggggctacagaagatgagctcaagtgtccgtgccaagtgccggctgctgagttctttactgaagtggatggggtgagactccaccgttacgcccctccatgtaagcccctgttgagagaagagatcactttctcggtagggttgcattcctacgcgataggatctcaactcccctgtgagccagaaccagatgtttctgtgttgacctcgatgttgagagacccttctcatatcaccgccgagacggcagcgcgccgccttgcgcgcgggtcccctccatcagaggcaagctcatccgccagccaactatcggctccgtcgttgaaggccacttgccagacgcataggcctcatccagacgctgagctggtggacgccaacttgttatggcggcaagagatgggcagcaacattacacgggtggagtctgaaacgaaggttgtgattcttgattcattcgaacctctgagagccgaagctgacgacgccgagctctcggtggctgcagagtgtttcaagaagcctcccaagtatcctccagcccttcctatctgggccaggccggactacaaccctccactgttggaccgctggaaagcaccggattatgtaccaccaactgtccatggatgtgccttaccaccacggggcgctccaccggtgcctcctcctcggaggaaaagaacaatccagctggacggctccaatgtgtccgcggcgctagctgcgctagcggaaaaatcattcccgaccccaaaatcgcaggaagagaatagctcatcctctggggtcgacacacagtccagcactacctccaggatgcccccctctccaggaggggagtccgactcagagtcatgctcgtccatgcctcctctcgagggagagccgggcgatccggacttgagttgcgactcttggtccaccgttagtgacaacgaggagcagagcgtggtctgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 22 - DNA, 9636 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtggggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgcagcggcgattggctgcgtgacatctgggactgggtttgctcggtgttgtccgacttcaagacgtggctctctgctaagattatgccagcactccctgggctgcccttcatctcctgtcaaaagggatacaagggcgtgtggcggggggatggtgtgatgtcgacacgctgtccttgcggggcatcaatcactggccacgtgaagaatgggtccatgcggcttgcggggccgcgtatgtgtgctaacatgtggcacggtactttccccatcaatgagtacaccaccggacccagcacaccttgcccatcacccaactacactcgcgcactatggcgcgtggctgccagcagctacgttgaggtgcgccgggtgggggacttccattatattacgggggctacagaagatgagctcaagtgtccgtgccaagtgccggctgctgagttctttactgaagtggatggggtgagactccaccgttacgcccctccatgtaagcccctgttgagagaagagatcactttctcggtagggttgcattcctacgcgataggatctcaactcccctgtgagccagaaccagatgtttctgtgttgacctcgatgttgagagacccttctcatatcaccgccgagacggcagcgcgccgccttgcgcgcgggtcccctccatcagaggcaagctcatccgccagccaactatcggctccgtcgttgaaggccacttgccagacgcataggcctcatccagacgctgagctggtggacgccaacttgttatggcggcaagagatgggcagcaacattacacgggtggagtctgaaacgaaggttgtgattcttgattcattcgaacctctgagagccgaagctgacgacgccgagctctcggtggctgcagagtgtttcaagaagcctcccaagtatcctccagcccttcctatctgggccaggccggactacaaccctccactgttggaccgctggaaagcaccggattatgtaccaccaactgtccatggatgtgccttaccaccacggggcgctccaccggtgcctcctcctcggaggaaaagaacaatccagctggacggctccaatgtgtccgcggcgctagctgcgctagcggaaaaatcattcccgaccccaaaatcgcaggaagagaatagctcatcctctggggtcgacacacagtccagcactacctccaggatgcccccctctccaggaggggagtccgactcagagtcatgctcgtccatgcctcctctcgagggagagccgggcgatccggacttgagttgcgactctcggtccaccgttagtgacaacgaggagcagagcgtggtctgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 23 - DNA, 9636 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtggggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttcccctggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgcagcggcggttggctgcgtgacatctgggactgggtttgctcggtgttgtccgacttcaagacgtggctctctgctaagattatgccagcactccctgggctgcccttcatctcctgtcaaaagggatacaagggcgtgtggcggggggatggtgtgatgtcgacacgctgtccttgcggggcatcaatcactggccacgtgaagaatgggtccatgcggcttgcggggccgcgtatgtgtgctaacatgtggcacggtactttccccatcaatgagtacaccaccggacccagcacaccttgcccatcacccaactacactcgcgcactatggcgcgtggctgccagcagctacgttgaggtgcgccgggtgggggacttccattatattacgggggctacagaagatgagctcaagtgtccgtgccaagtgccggctgctgagttctttactgaagtggatggggtgagactccaccgttacgcccctccatgtaagcccctgttgagagaagagatcactttctcggtagggttgcattcctacgcgataggatctcaactcccctgtgagccagaaccagatgtttctgtgttgacctcgatgttgagagacccttctcatatcaccgccgagacggcagcgcgccgccttgcgcgcgggtcccctccatcagaggcaagctcatccgccagccaactatcggctccgtcgttgaaggccacttgccagacgcataggcctcatccagacgctgagctggtggacgccaacttgttatggcggcaagagatgggcagcaacattacacgggtggagtctgaaacgaaggttgtgattcttgattcattcgaacctctgagagccgaagctgacgacgccgagctctcggtggctgcagagtgtttcaagaagcctcccaagtatcctccagcccttcctatctgggccaggccggactacaaccctccactgttggaccgctggaaagcaccggattatgtaccaccaactgtccatggatgtgccttaccaccacggggcgctccaccggtgcctcctcctcggaggaaaagaacaatccagctggacggctccaatgtgtccgcggcgctagctgcgctagcggaaaaatcattcccgaccccaaaatcgcaggaagagaatagctcatcctctggggtcgacacacagtccagcactacctccaggatgcccccctctccaggaggggagtccgactcagagtcatgctcgtccatgcctcctctcgagggagagccgggcgatccggacttgagttgcgactctcggtccaccgttagtgacaacgaggagcagagcgtggtctgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 24 - DNA, 9615 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgcgccgaatcttggctatgggaggtatgggattgggtctgcaccgtgctgagtgacttcaagacgtggctaaaagccaagttgctgcccctcatgccaggcatccccttcctctcatgccagaggggctataagggagagtggcgcggagatggcgtgatgcataccacatgcccctgcggagcagatctggcaggtcacatcaagaacggctcgatgagaatcaccgggccgaaaacctgcagcaacacatggcatggtaccttccccatcaatgcttacaccacaggccctggtgtacccatcccggcgccgaactacaagttcgcgctttggagggtgtccgccgaggactacgtggaggttcgcagagtgggtgatttccattatgtcaccggggtaacacaagacaacatcaagtgcccctgccaagttccggccccagagttcttcacggaagtggacggcatcaggctacaccgccacgccccgaagtgcaaacccttgctgcgggacgaagtgtcgttctcagtaggactcaattcgttcgtagtgggatcacaactcccatgcgagccagagccggacgtggcagtgctaacatccatgctgacagacccatcacacataacggcggaatcggcgcgtcggagattggctcgagggtcacgaccctcgctagctagttcctcggcgagtcagctttccgccccgtctctcaaggccacgtgtaccgctccccatgactcccctggtactgatctcctcgaggctaacctcttgtgggggtctaccgctaccagggttgagacggacgagaaggtaataatactagactcttttgagtcatgtgtggctgagccaaatgatgacagggaagtctcggttgccgcggaaatcctgcgtccgaccaagaagttccctccagcactaccgatctgggcccggccggattacaatccacctcttaccgagacgtggaagcagcaggactacaagcctccgaccgtccacgggtgcgctctgcctcccggcaagcagccccccgttcctcctcccaggaggaaacggacggtacagctcactgagtccgttgtttctaccgctttggcagagctggccgcaaagacctttggccagtcagagccgagctcagaccgtgatacagaccttaccaccccaactgagaccacagactcgggccccatcgtcgtggatgatgcatccgatgacggatcttattcgtcaatgcctccactagagggggagcccggtgacccggacttgacatcagactcttggtccactgttagcggatcggaggacgtcgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 25 - DNA, 9615 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatcttttccgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgcgccgaatcttggctatgggaggtatgggattgggtctgcaccgtgctgagtgacttcaagacgtggctaaaagccaagttgctgcccctcatgccaggcatccccttcctctcatgccagaggggctataagggagagtggcgcggagatggcgtgatgcataccacatgcccctgcggagcagatctggcaggtcacatcaagaacggctcgatgagaatcaccgggccgaaaacctgcagcaacacatggcatggtaccttccccatcaatgcttacaccacaggccctggtgtacccatcccggcgccgaactacaagttcgcgctttggagggtgtccgccgaggactacgtggaggttcgcagagtgggtgatttccattatgtcaccggggtaacacaagacaacatcaagtgcccctgccaagttccggccccagagttcttcacggaagtggacggcatcaggctacaccgccacgccccgaagtgcaaacccttgctgcgggacgaagtgtcgttctcagtaggactcaattcgttcgtagtgggatcacaactcccatgcgagccagagccggacgtggcagtgctaacatccatgctgacagacccatcacacataacggcggaatcggcgcgtcggagattggctcgagggtcacgaccctcgctagctagttcctcggcgagtcagctttccgccccgtctctcaaggccacgtgtaccgctccccatgactcccctggtactgatctcctcgaggctaacctcttgtgggggtctaccgctaccagggttgagacggacgagaaggtaataatactagactcttttgagtcatgtgtggctgagccaaatgatgacagggaagtctcggttgccgcggaaatcctgcgtccgaccaagaagttccctccagcactaccgatctgggcccggccggattacaatccacctcttaccgagacgtggaagcagcaggactacaagcctccgaccgtccacgggtgcgctctgcctcccggcaagcagccccccgttcctcctcccaggaggaaacggacggtacagctcactgagtccgttgtttctaccgctttggcagagctggccgcaaagacctttggccagtcagagccgagctcagaccgtgatacagaccttaccaccccaactgagaccacagactcgggccccatcgtcgtggatgatgcatccgatgacggatcttattcgtcaatgcctccactagagggggagcccggtgacccggacttgacatcagactcttggtccactgttagcggatcggaggacgtcgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 26 - DNA, 9615 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagcacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgcgccgaatcttggctatgggaggtatgggattgggtctgcaccgtgctgagtgacttcaagacgtggctaaaagccaagttgctgcccctcatgccaggcatccccttcctctcatgccagaggggctataagggagagtggcgcggagatggcgtgatgcataccacatgcccctgcggagcagatctggcaggtcacatcaagaacggctcgatgagaatcaccgggccgaaaacctgcagcaacacatggcatggtaccttccccatcaatgcttacaccacaggccctggtgtacccatcccggcgccgaactacaagttcgcgctttggagggtgtccgccgaggactacgtggaggttcgcagagtgggtgatttccattatgtcaccggggtaacacaagacaacatcaagtgcccctgccaagttccggccccagagttcttcacggaagtggacggcatcaggctacaccgccacgccccgaagtgcaaacccttgctgcgggacgaagtgtcgttctcagtaggactcaattcgttcgtagtgggatcacaactcccatgcgagccagagccggacgtggcagtgctaacatccatgctgacagacccatcacacataacggcggaatcggcgcgtcggagattggctcgagggtcacgaccctcgctagctagttcctcggcgagtcagctttccgccccgtctctcaaggccacgtgtaccgctccccatgactcccctggtactgatctcctcgaggctaacctcttgtgggggtctaccgctaccagggttgagacggacgagaaggtaataatactagactcttttgagtcatgtgtggctgagccaaatgatgacagggaagtctcggttgccgcggaaatcctgcgtccgaccaagaagttccctccagcactaccgatctgggcccggccggattacaatccacctcttaccgagacgtggaagcagcaggactacaagcctccgaccgtccacgggtgcgctctgcctcccggcaagcagccccccgttcctcctcccaggaggaaacggacggtacagctcactgagtccgttgtttctaccgctttggcagagctggccgcaaagacctttggccagtcagagccgagctcagaccgtgatacagaccttaccaccccaactgagaccacagactcgggccccatcgtcgtggatgatgcatccgatgacggatcttattcgtcaatgcctccactagagggggagcccggtgacccggacttgacatcagactcttggtccactgttagcggatcggaggacgtcgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 27 - DNA, 9615 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgcgccgaatcttggctatgggaggtatgggattgggtctgcaccgtgctgagtgacttcaagacgtggctaaaagccaagttgctgcccctcatgccaggcatccccttcctctcatgccagaggggctataagggagagtggcgcggagatggcgtgatgcataccacatgcccctgcggagcagatctggcaggtcacatcaagaacggctcgatgagaatcaccgggccgaaaacctgcagcaacacatggcatggtaccttccccatcaatgcttacaccacaggccctggtgtacccatcccggcgccgaactacaagttcgcgctttggagggtgtccgccgaggactacgtggaggttcgcagagtgggtgatttccattatgtcaccggggtaacacaagacaacatcaagtgcccctgccaagttccggccccagagttcttcacggaagtggacggcatcaggctacaccgccacgccccgaagtgcaaacccttgctgcgggacgaagtgtcgttctcagtaggactcaattcgttcgtagtgggatcacaactcccatgcgagccagagccggacgtggcagtgctaacatccatgctgacagacccatcacacataacggcggaatcggcgcgtcggagattggctcgagggtcacgaccctcgctagctagttcctcggcgagtcagctttccgccccgtctctcaaggccacgtgtaccgctccccatgactcccctggtactgatctcctcgaggctaacctcttgtgggggtctaccgctaccagggttgagacggacgagaaggtaataatactagactcttttgagtcatgtgtggctgagccaaatgatgacaggggagtctcggttgccgcggaaatcctgcgtccgaccaagaagttccctccagcactaccgatctgggcccggccggattacaatccacctcttaccgagacgtggaagcagcaggactacaagcctccgaccgtccacgggtgcgctctgcctcccggcaagcagccccccgttcctcctcccaggaggaaacggacggtacagctcactgagtccgttgtttctaccgctttggcagagctggccgcaaagacctttggccagtcagagccgagctcagaccgtgatacagaccttaccaccccaactgagaccacagactcgggccccatcgtcgtggatgatgcatccgatgacggatcttattcgtcaatgcctccactagagggggagcccggtgacccggacttgacatcagactcttggtccactgttagcggatcggaggacgtcgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 28 - DNA, 9615 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgcgccgaatcttggctatgggaggtatgggattgggtctgcaccgtgctgagtgacttcaagacgtggctaaaagccaagttgctgcccctcatgccaggcatccccttcctctcatgccagaggggctataagggagagtggcgcggagatggcgtgatgcataccacatgcccctgcggagcagatctggcaggtcacatcaagaacggctcgatgagaatcaccgggccgaaaacctgcagcaacacatggcatggtaccttccccatcaatgcttacaccacaggccctggtgtacccatcccggcgccgaactacaagttcgcgctttggagggtgtccgccgaggactacgtggaggttcgcagagtgggtgatttccattatgtcaccggggtaacacaagacaacatcaagtgcccctgccaagttccggccccagagttcttcacggaagtggacggcatcaggctacaccgccacgccccgaagtgcaaacccttgctgcgggacgaagtgtcgttctcagtaggactcaattcgttcgtagtgggatcacaactcccatgcgagccagagccggacgtggcagtgctaacatccatgctgacagacccatcacacataacggcggaatcggcgcgtcggagattggctcgagggtcacgaccctcgctagctagttcctcggcgagtcagctttccgccccgtctctcaaggccacgtgtaccgctccccatgactcccctggtactgatctcctcgaggctaacctcttgtgggggtctaccgctaccagggttgagacggacgagaaggtaataatactagactcttttgagtcatgtgtggctgagccaaatgatgacagggaagtctcggttgccgcggaaatcctgcgtccgaccaagaagttccctccagcactaccgatctgggcccggccggattacaatccacctcttaccgagacgtggaagcagcaggactacaagcctccgaccgtccacgggtgcgctctgcctcccggcaagcagccccccgttcctcctcccaggaggaaacggacggtacagctcactgagtccgttgtttctaccgctttggcagagctggccgcaaagacctttggccagtcagagccgagctcagaccgtgatacagaccttaccaccccaactgagaccacagactcgggccccatcgtcgtggatgatgcatccgatgacggatcttattcgtcaatgcctccactagagggggagcccggtgacccggacttgacatcagactcttggtccactgttagcggatcgggggacgtcgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 29 - DNA, 9615 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatcttttccgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagcacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgcgccgaatcttggctatgggaggtatgggattgggtctgcaccgtgctgagtgacttcaagacgtggctaaaagccaagttgctgcccctcatgccaggcatccccttcctctcatgccagaggggctataagggagagtggcgcggagatggcgtgatgcataccacatgcccctgcggagcagatctggcaggtcacatcaagaacggctcgatgagaatcaccgggccgaaaacctgcagcaacacatggcatggtaccttccccatcaatgcttacaccacaggccctggtgtacccatcccggcgccgaactacaagttcgcgctttggagggtgtccgccgaggactacgtggaggttcgcagagtgggtgatttccattatgtcaccggggtaacacaagacaacatcaagtgcccctgccaagttccggccccagagttcttcacggaagtggacggcatcaggctacaccgccacgccccgaagtgcaaacccttgctgcgggacgaagtgtcgttctcagtaggactcaattcgttcgtagtgggatcacaactcccatgcgagccagagccggacgtggcagtgctaacatccatgctgacagacccatcacacataacggcggaatcggcgcgtcggagattggctcgagggtcacgaccctcgctagctagttcctcggcgagtcagctttccgccccgtctctcaaggccacgtgtaccgctccccatgactcccctggtactgatctcctcgaggctaacctcttgtgggggtctaccgctaccagggttgagacggacgagaaggtaataatactagactcttttgagtcatgtgtggctgagccaaatgatgacagggaagtctcggttgccgcggaaatcctgcgtccgaccaagaagttccctccagcactaccgatctgggcccggccggattacaatccacctcttaccgagacgtggaagcagcaggactacaagcctccgaccgtccacgggtgcgctctgcctcccggcaagcagccccccgttcctcctcccaggaggaaacggacggtacagctcactgagtccgttgtttctaccgctttggcagagctggccgcaaagacctttggccagtcagagccgagctcagaccgtgatacagaccttaccaccccaactgagaccacagactcgggccccatcgtcgtggatgatgcatccgatgacggatcttattcgtcaatgcctccactagagggggagcccggtgacccggacttgacatcagactcttggtccactgttagcggatcggaggacgtcgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 30 - DNA, 9615 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatcttttccgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgcgccgaatcttggctatgggaggtatgggattgggtctgcaccgtgctgagtgacttcaagacgtggctaaaagccaagttgctgcccctcatgccaggcatccccttcctctcatgccagaggggctataagggagagtggcgcggagatggcgtgatgcataccacatgcccctgcggagcagatctggcaggtcacatcaagaacggctcgatgagaatcaccgggccgaaaacctgcagcaacacatggcatggtaccttccccatcaatgcttacaccacaggccctggtgtacccatcccggcgccgaactacaagttcgcgctttggagggtgtccgccgaggactacgtggaggttcgcagagtgggtgatttccattatgtcaccggggtaacacaagacaacatcaagtgcccctgccaagttccggccccagagttcttcacggaagtggacggcatcaggctacaccgccacgccccgaagtgcaaacccttgctgcgggacgaagtgtcgttctcagtaggactcaattcgttcgtagtgggatcacaactcccatgcgagccagagccggacgtggcagtgctaacatccatgctgacagacccatcacacataacggcggaatcggcgcgtcggagattggctcgagggtcacgaccctcgctagctagttcctcggcgagtcagctttccgccccgtctctcaaggccacgtgtaccgctccccatgactcccctggtactgatctcctcgaggctaacctcttgtgggggtctaccgctaccagggttgagacggacgagaaggtaataatactagactcttttgagtcatgtgtggctgagccaaatgatgacaggggagtctcggttgccgcggaaatcctgcgtccgaccaagaagttccctccagcactaccgatctgggcccggccggattacaatccacctcttaccgagacgtggaagcagcaggactacaagcctccgaccgtccacgggtgcgctctgcctcccggcaagcagccccccgttcctcctcccaggaggaaacggacggtacagctcactgagtccgttgtttctaccgctttggcagagctggccgcaaagacctttggccagtcagagccgagctcagaccgtgatacagaccttaccaccccaactgagaccacagactcgggccccatcgtcgtggatgatgcatccgatgacggatcttattcgtcaatgcctccactagagggggagcccggtgacccggacttgacatcagactcttggtccactgttagcggatcggaggacgtcgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 31 - DNA, 9615 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatcttttccgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgcgccgaatcttggctatgggaggtatgggattgggtctgcaccgtgctgagtgacttcaagacgtggctaaaagccaagttgctgcccctcatgccaggcatccccttcctctcatgccagaggggctataagggagagtggcgcggagatggcgtgatgcataccacatgcccctgcggagcagatctggcaggtcacatcaagaacggctcgatgagaatcaccgggccgaaaacctgcagcaacacatggcatggtaccttccccatcaatgcttacaccacaggccctggtgtacccatcccggcgccgaactacaagttcgcgctttggagggtgtccgccgaggactacgtggaggttcgcagagtgggtgatttccattatgtcaccggggtaacacaagacaacatcaagtgcccctgccaagttccggccccagagttcttcacggaagtggacggcatcaggctacaccgccacgccccgaagtgcaaacccttgctgcgggacgaagtgtcgttctcagtaggactcaattcgttcgtagtgggatcacaactcccatgcgagccagagccggacgtggcagtgctaacatccatgctgacagacccatcacacataacggcggaatcggcgcgtcggagattggctcgagggtcacgaccctcgctagctagttcctcggcgagtcagctttccgccccgtctctcaaggccacgtgtaccgctccccatgactcccctggtactgatctcctcgaggctaacctcttgtgggggtctaccgctaccagggttgagacggacgagaaggtaataatactagactcttttgagtcatgtgtggctgagccaaatgatgacagggaagtctcggttgccgcggaaatcctgcgtccgaccaagaagttccctccagcactaccgatctgggcccggccggattacaatccacctcttaccgagacgtggaagcagcaggactacaagcctccgaccgtccacgggtgcgctctgcctcccggcaagcagccccccgttcctcctcccaggaggaaacggacggtacagctcactgagtccgttgtttctaccgctttggcagagctggccgcaaagacctttggccagtcagagccgagctcagaccgtgatacagaccttaccaccccaactgagaccacagactcgggccccatcgtcgtggatgatgcatccgatgacggatcttattcgtcaatgcctccactagagggggagcccggtgacccggacttgacatcagactcttggtccactgttagcggatcgggggacgtcgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 32 - DNA, 9615 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatcttttccgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagcacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgcgccgaatcttggctatgggaggtatgggattgggtctgcaccgtgctgagtgacttcaagacgtggctaaaagccaagttgctgcccctcatgccaggcatccccttcctctcatgccagaggggctataagggagagtggcgcggagatggcgtgatgcataccacatgcccctgcggagcagatctggcaggtcacatcaagaacggctcgatgagaatcaccgggccgaaaacctgcagcaacacatggcatggtaccttccccatcaatgcttacaccacaggccctggtgtacccatcccggcgccgaactacaagttcgcgctttggagggtgtccgccgaggactacgtggaggttcgcagagtgggtgatttccattatgtcaccggggtaacacaagacaacatcaagtgcccctgccaagttccggccccagagttcttcacggaagtggacggcatcaggctacaccgccacgccccgaagtgcaaacccttgctgcgggacgaagtgtcgttctcagtaggactcaattcgttcgtagtgggatcacaactcccatgcgagccagagccggacgtggcagtgctaacatccatgctgacagacccatcacacataacggcggaatcggcgcgtcggagattggctcgagggtcacgaccctcgctagctagttcctcggcgagtcagctttccgccccgtctctcaaggccacgtgtaccgctccccatgactcccctggtactgatctcctcgaggctaacctcttgtgggggtctaccgctaccagggttgagacggacgagaaggtaataatactagactcttttgagtcatgtgtggctgagccaaatgatgacaggggagtctcggttgccgcggaaatcctgcgtccgaccaagaagttccctccagcactaccgatctgggcccggccggattacaatccacctcttaccgagacgtggaagcagcaggactacaagcctccgaccgtccacgggtgcgctctgcctcccggcaagcagccccccgttcctcctcccaggaggaaacggacggtacagctcactgagtccgttgtttctaccgctttggcagagctggccgcaaagacctttggccagtcagagccgagctcagaccgtgatacagaccttaccaccccaactgagaccacagactcgggccccatcgtcgtggatgatgcatccgatgacggatcttattcgtcaatgcctccactagagggggagcccggtgacccggacttgacatcagactcttggtccactgttagcggatcggaggacgtcgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 33 - DNA, 9630 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgcgatggcacatggctaagggccatttgggactgggtctgcacggcactgacagacttcaaagcctggctgcaggcaaaactcctcccacaactccccggagtgcccttcctctcgtgtcagagagggtacaagggcgtatggcgtggggatggagtaaattccaccaagtgtccgtgcggagcgacgatatctggccacgtgaaaaacggaaccatgaggatcgtcggcccgaagctgtgcagcaacacctggcacggaaccttccccatcaacgccacaacaacggggcccagtgtgcctgctccggcccccaactacaagtttgccttgtggagggtaggcgctgcggactacgccgaggtgcgccgcgtgggggactaccattacatcacgggggtgacacaggacaatctgaagtgtccctgtcaggtaccatctccagagttcttcacggagctggacggcgtgaggattcaccgctacgcgccaccctgcaaccccctcctaagggaggaggtctgcttctccgtggggctgcactcctttgtggtggggtcccaactaccctgtgagccagaacctgatgtgaccgtcctaacgtcaatgctgtcagaccctgctcacatcacggcagagacggccaagcgcaggctagatcgagggtctccgccctctctagctagctcctcggccagccaactctcggccccctcccttaaggctacttgcactacacaaggtcaccatccagacgcagacctcatagaggctaatctgctatggagacagtgcatgggaggtaacatcacgcgagtggaagccgagaacaaggtcgtgatccttgactcctttgagccgcttaaggcggatgacgacgacagagagatctctgtgtccgctgactgctttaggaggggaccggcgtttccccccgccctgccagtatgggcaaggccggggtatgacccacccctcctggagacttggaagcagcctgattatgaccccccccaggtgtcaggttgcccgctaccacctgcgggtctcccacctgtcccgcctccacgtaggaagaggaaaccggtggtgctatctgactccaacgtgtcccaagtcctggccgacttggcgcatgccaggttcaaggccgacacgcaatccattgaaggccaggattctgcggtgggcaccagtagccaacccgactcagggcctgaggagaagcgtgatgatgactcggacgcggcttcatattcttccatgcctccgctggagggcgagcctggggaccctgacctttcgtcagggtcgtggtcaactgtcagcgatgaggacagtgtggtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 34 - DNA, 9630 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatcttttccgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgcgatggcacatggctaagggccatttgggactgggtctgcacggcactgacagacttcaaagcctggctgcaggcaaaactcctcccacaactccccggagtgcccttcctctcgtgtcagagagggtacaagggcgtatggcgtggggatggagtaaattccaccaagtgtccgtgcggagcgacgatatctggccacgtgaaaaacggaaccatgaggatcgtcggcccgaagctgtgcagcaacacctggcacggaaccttccccatcaacgccacaacaacggggcccagtgtgcctgctccggcccccaactacaagtttgccttgtggagggtaggcgctgcggactacgccgaggtgcgccgcgtgggggactaccattacatcacgggggtgacacaggacaatctgaagtgtccctgtcaggtaccatctccagagttcttcacggagctggacggcgtgaggattcaccgctacgcgccaccctgcaaccccctcctaagggaggaggtctgcttctccgtggggctgcactcctttgtggtggggtcccaactaccctgtgagccagaacctgatgtgaccgtcctaacgtcaatgctgtcagaccctgctcacatcacggcagagacggccaagcgcaggctagatcgagggtctccgccctctctagctagctcctcggccagccaactctcggccccctcccttaaggctacttgcactacacaaggtcaccatccagacgcagacctcatagaggctaatctgctatggagacagtgcatgggaggtaacatcacgcgagtggaagccgagaacaaggtcgtgatccttgactcctttgagccgcttaaggcggatgacgacgacagagagatctctgtgtccgctgactgctttaggaggggaccggcgtttccccccgccctgccagtatgggcaaggccggggtatgacccacccctcctggagacttggaagcagcctgattatgaccccccccaggtgtcaggttgcccgctaccacctgcgggtctcccacctgtcccgcctccacgtaggaagaggaaaccggtggtgctatctgactccaacgtgtcccaagtcctggccgacttggcgcatgccaggttcaaggccgacacgcaatccattgaaggccaggattctgcggtgggcaccagtagccaacccgactcagggcctgaggagaagcgtgatgatgactcggacgcggcttcatattcttccatgcctccgctggagggcgagcctggggaccctgacctttcgtcagggtcgtggtcaactgtcagcgatgaggacagtgtggtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 35 - DNA, 9630 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgcgatggcacatggctaggggccatttgggactgggtctgcacggcactgacagacttcaaagcctggctgcaggcaaaactcctcccacaactccccggagtgcccttcctctcgtgtcagagagggtacaagggcgtatggcgtggggatggagtaaattccaccaagtgtccgtgcggagcgacgatatctggccacgtgaaaaacggaaccatgaggatcgtcggcccgaagctgtgcagcaacacctggcacggaaccttccccatcaacgccacaacaacggggcccagtgtgcctgctccggcccccaactacaagtttgccttgtggagggtaggcgctgcggactacgccgaggtgcgccgcgtgggggactaccattacatcacgggggtgacacaggacaatctgaagtgtccctgtcaggtaccatctccagagttcttcacggagctggacggcgtgaggattcaccgctacgcgccaccctgcaaccccctcctaagggaggaggtctgcttctccgtggggctgcactcctttgtggtggggtcccaactaccctgtgagccagaacctgatgtgaccgtcctaacgtcaatgctgtcagaccctgctcacatcacggcagagacggccaagcgcaggctagatcgagggtctccgccctctctagctagctcctcggccagccaactctcggccccctcccttaaggctacttgcactacacaaggtcaccatccagacgcagacctcatagaggctaatctgctatggagacagtgcatgggaggtaacatcacgcgagtggaagccgagaacaaggtcgtgatccttgactcctttgagccgcttaaggcggatgacgacgacagagagatctctgtgtccgctgactgctttaggaggggaccggcgtttccccccgccctgccagtatgggcaaggccggggtatgacccacccctcctggagacttggaagcagcctgattatgaccccccccaggtgtcaggttgcccgctaccacctgcgggtctcccacctgtcccgcctccacgtaggaagaggaaaccggtggtgctatctgactccaacgtgtcccaagtcctggccgacttggcgcatgccaggttcaaggccgacacgcaatccattgaaggccaggattctgcggtgggcaccagtagccaacccgactcagggcctgaggagaagcgtgatgatgactcggacgcggcttcatattcttccatgcctccgctggagggcgagcctggggaccctgacctttcgtcagggtcgtggtcaactgtcagcgatgaggacagtgtggtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 36 - DNA, 9630 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgcgatggcacatggctaggggccatttgggactgggtctgcacggcactgacagacttcaaagcctggctgcaggcaaaactcctcccacaactccccggagtgcccttcctctcgtgtcagagagggtacaagggcgtatggcgtggggatggagtaaattccaccaagtgtccgtgcggagcgacgatatctggccacgtgaaaaacggaaccatgaggatcgtcggcccgaagctgtgcagcaacacctggcacggaaccttccccatcaacgccacaacaacggggcccagtgtgcctgctccggcccccaactacaagtttgccttgtggagggtaggcgctgcggactacgccgaggtgcgccgcgtgggggactaccattacatcacgggggtgacacaggacaatctgaagtgtccctgtcaggtaccatctccagagttcttcacggagctggacggcgtgaggattcaccgctacgcgccaccctgcaaccccctcctaagggaggaggtctgcttctccgtggggctgcactcctttgtggtggggtcccaactaccctgtgagccagaacctgatgtgaccgtcctaacgtcaatgctgtcagaccctgctcacatcacggcagagacggccaagcgcaggctagatcgagggtctccgccctctctagctagctcctcggccagccaactctcggccccctcccttaaggctacttgcactacacaaggtcaccatccagacgtagacctcatagaggctaatctgctatggagacagtgcatgggaggtaacatcacgcgagtggaagccgagaacaaggtcgtgatccttgactcctttgagccgcttaaggcggatgacgacgacagagagatctctgtgtccgctgactgctttaggaggggaccggcgtttccccccgccctgccagtatgggcaaggccggggtatgacccacccctcctggagacttggaagcagcctgattatgaccccccccaggtgtcaggttgcccgctaccacctgcgggtctcccacctgtcccgcctccacgtaggaagaggaaaccggtggtgctatctgactccaacgtgtcccaagtcctggccgacttggcgcatgccaggttcaaggccgacacgcaatccattgaaggccaggattctgcggtgggcaccagtagccaacccgactcagggcctgaggagaagcgtgatgatgactcggacgcggcttcatattcttccatgcctccgctggagggcgagcctggggaccctgacctttcgtcagggtcgtggtcaactgtcagcgatgaggacagtgtggtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 37 - DNA, 9630 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgcgatggcacatggctaggggccatttgggactgggtctgcacggcactgacagacttcaaagcctggctgcaggcaaaactcctcccacaactccccggagtgcccttcctctcgtgtcagagagggtacaagggcgtatggcgtggggatggagtaaattccaccaagtgtccgtgcggagcgacgatatctggccacgtgaaaaacggaaccatgaggatcgtcggcccgaagctgtgcagcaacacctggcacggaaccttccccatcaacgccacaacaacggggcccagtgtgcctgctccggcccccaactacaagtttgccttgtggagggtaggcgctgcggactacgccgaggtgcgccgcgtgggggactaccattacatcacgggggtgacacaggacaatctgaagtgtccctgtcaggtaccatctccagagttcttcacggagctggacggcgtgaggattcaccgctacgcgccaccctgcaaccccctcctaagggaggaggtctgcttctccgtggggctgcactcctttgtggtggggtcccaactaccctgtgagccagaacctgatgtgaccgtcctaacgtcaatgctgtcagaccctgctcacatcacggcagagacggccaagcgcaggctagatcgagggtctccgccctctctagctagctcctcggccagccaactctcggccccctcccttaaggctacttgcactacacaaggtcaccatccagacgcagacctcatagaggctaatctgctatggagacagtgcatgggaggtaacatcacgcgagtggaagccgagaacaaggtcgtgatccttgactcctttgagccgcttaaggcggatgacgacgacagagagatctctgtgtccgctgactgctttaggaggggaccggcgtttccccccgccctgccagtatgggcaaggccggggtatgacccacccctcctggagacttggaagcagcctgattatgaccccctccaggtgtcaggttgcccgctaccacctgcgggtctcccacctgtcccgcctccacgtaggaagaggaaaccggtggtgctatctgactccaacgtgtcccaagtcctggccgacttggcgcatgccaggttcaaggccgacacgcaatccattgaaggccaggattctgcggtgggcaccagtagccaacccgactcagggcctgaggagaagcgtgatgatgactcggacgcggcttcatattcttccatgcctccgctggagggcgagcctggggaccctgacctttcgtcagggtcgtggtcaactgtcagcgatgaggacagtgtggtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 38 - DNA, 9630 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgcgatggcacatggctaggggccatttgggactgggtctgcacggcactgacagacttcaaagcctggctgcaggcaaaactcctcccacaactccccggagtgcccttcctctcgtgtcagagagggtacaagggcgtatggcgtggggatggagtaaattccaccaagtgtccgtgcggagcgacgatatctggccacgtgaaaaacggaaccatgaggatcgtcggcccgaagctgtgcagcaacacctggcacggaaccttccccatcaacgccacaacaacggggcccagtgtgcctgctccggcccccaactacaagtttgccttgtggagggtaggcgctgcggactacgccgaggtgcgccgcgtgggggactaccattacatcacgggggtgacacaggacaatctgaagtgtccctgtcaggtaccatctccagagttcttcacggagctggacggcgtgaggattcaccgctacgcgccaccctgcaaccccctcctaagggaggaggtctgcttctccgtggggctgcactcctttgtggtggggtcccaactaccctgtgagccagaacctgatgtgaccgtcctaacgtcaatgctgtcagaccctgctcacatcacggcagagacggccaagcgcaggctagatcgagggtctccgccctctctagctagctcctcggccagccaactctcggccccctcccttaaggctacttgcactacacaaggtcaccatccagacgcagacctcatagaggctaatctgctatggagacagtgcatgggaggtaacatcacgcgagtggaagccgagaacaaggtcgtgatccttgactcctttgagccgcttaaggcggatgacgacgacagagagatctctgtgtccgctgactgctttaggaggggaccggcgtttccccccgccctgccagtatgggcaaggccggggtatgacccacccctcctggagacttggaagcagcctgattatgaccccccccaggtgtcaggttgcccgctaccacctgcgggtctcccacctgtcccgcctccacgtaggaagaggaaaccggtggtgctatctgactccaacgtgtcccaagtcctggccgacttggcgcatgccaggttcaaggccgacacgcaatccattgaaggccaggattctgcggtgggcaccagtagccaacccgactcagggcctgaggagaagcgtgatgatgactcggacgcggcttcatattcttccatgcctccgctggagggcgagcctggggaccctgacctttcgtcagggtcgtggtcaactgtcagcgatgaggacggtgtggtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 39 - DNA, 9630 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatcttttccgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgcgatggcacatggctaggggccatttgggactgggtctgcacggcactgacagacttcaaagcctggctgcaggcaaaactcctcccacaactccccggagtgcccttcctctcgtgtcagagagggtacaagggcgtatggcgtggggatggagtaaattccaccaagtgtccgtgcggagcgacgatatctggccacgtgaaaaacggaaccatgaggatcgtcggcccgaagctgtgcagcaacacctggcacggaaccttccccatcaacgccacaacaacggggcccagtgtgcctgctccggcccccaactacaagtttgccttgtggagggtaggcgctgcggactacgccgaggtgcgccgcgtgggggactaccattacatcacgggggtgacacaggacaatctgaagtgtccctgtcaggtaccatctccagagttcttcacggagctggacggcgtgaggattcaccgctacgcgccaccctgcaaccccctcctaagggaggaggtctgcttctccgtggggctgcactcctttgtggtggggtcccaactaccctgtgagccagaacctgatgtgaccgtcctaacgtcaatgctgtcagaccctgctcacatcacggcagagacggccaagcgcaggctagatcgagggtctccgccctctctagctagctcctcggccagccaactctcggccccctcccttaaggctacttgcactacacaaggtcaccatccagacgcagacctcatagaggctaatctgctatggagacagtgcatgggaggtaacatcacgcgagtggaagccgagaacaaggtcgtgatccttgactcctttgagccgcttaaggcggatgacgacgacagagagatctctgtgtccgctgactgctttaggaggggaccggcgtttccccccgccctgccagtatgggcaaggccggggtatgacccacccctcctggagacttggaagcagcctgattatgaccccccccaggtgtcaggttgcccgctaccacctgcgggtctcccacctgtcccgcctccacgtaggaagaggaaaccggtggtgctatctgactccaacgtgtcccaagtcctggccgacttggcgcatgccaggttcaaggccgacacgcaatccattgaaggccaggattctgcggtgggcaccagtagccaacccgactcagggcctgaggagaagcgtgatgatgactcggacgcggcttcatattcttccatgcctccgctggagggcgagcctggggaccctgacctttcgtcagggtcgtggtcaactgtcagcgatgaggacagtgtggtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 40 - DNA, 9633 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgcgctacctcatggttgcgcgacgtgtgggactgggtgtgtacagtgttatctgattttagagtatggctgaaagccaaactcctcccacgcctgccggggatccccttcctctcgtgccaaacgggatataggggagtctgggcaggggacggggtgtgccacaccacttgtacctgtggggccgtgatagctggacacgtcaaaaatggcaccatgaaaatcacagggcccaagacatgcagtaacacttggcacgggacttttccaatcaacgccaccactaccggccccagcacaccacgaccagcgccgaactatcagcgcgctctttggcgggtatctgccgaggactacgttgaagtacggaggttgggcgactgccactatgtggtaggggtcactgctgaagggctgaagtgcccttgccaggtgcctgcgcctgaattcttcactgaggtcgatggcgtgaggatacaccgttacgcgccaccttgtaagcccttgctcagggacgaagtgacattctctgtgggtctttcaagctatgccatagggtctcagctcccttgtgagccagagcctgacgtgaccgtagtcacctcaatgctcacagaccccacgcacatcaccgcagagacggcagcacggcggttgaagagggggtcccccccctccttagccagctcttcggccagccagctgtctgcaccgtccctcaaggctacttgcacaacatccaaagaccacccggacatggaactcattgaggccaacctcctttggaggcaggagatgggaggcaacatcactcgggtcgagtcggagaacaaagttgtaatacttgactcctttgagcctttaaccgctgagtatgacgagagggaaatctcagtatcagctgagtgccataggccacctaggcgcaaattccctccagctctcccaatatgggccaggcctgactacaatccacctcttatacaagcatggcaaatgcccgggtacgagcctccagtcgtgtctggatgcgccgtcgccccacctaagccggcaccaattcccccgccgaggcggaagaggctagtgcacttggatgagtccacggtctcgcacgccttggcacagcttgccgacaaggtatttgtggagagtagtagtgacccaggacctagttcagactcgggactatcaatagccagtcccgttccacctgccccaacaacaccagacgacgcctgctcagaagcagggtcctatagctcaatgccccctcttgagggggagcctggtgaccctgacctaagctcaggttcttggtccactgtgagcgatcaggacgacgtcgtgtgttgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 41 - DNA, 9633 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatcttttccgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgcgctacctcatggttgcgcgacgtgtgggactgggtgtgtacagtgttatctgattttagagtatggctgaaagccaaactcctcccacgcctgccggggatccccttcctctcgtgccaaacgggatataggggagtctgggcaggggacggggtgtgccacaccacttgtacctgtggggccgtgatagctggacacgtcaaaaatggcaccatgaaaatcacagggcccaagacatgcagtaacacttggcacgggacttttccaatcaacgccaccactaccggccccagcacaccacgaccagcgccgaactatcagcgcgctctttggcgggtatctgccgaggactacgttgaagtacggaggttgggcgactgccactatgtggtaggggtcactgctgaagggctgaagtgcccttgccaggtgcctgcgcctgaattcttcactgaggtcgatggcgtgaggatacaccgttacgcgccaccttgtaagcccttgctcagggacgaagtgacattctctgtgggtctttcaagctatgccatagggtctcagctcccttgtgagccagagcctgacgtgaccgtagtcacctcaatgctcacagaccccacgcacatcaccgcagagacggcagcacggcggttgaagagggggtcccccccctccttagccagctcttcggccagccagctgtctgcaccgtccctcaaggctacttgcacaacatccaaagaccacccggacatggaactcattgaggccaacctcctttggaggcaggagatgggaggcaacatcactcgggtcgagtcggagaacaaagttgtaatacttgactcctttgagcctttaaccgctgagtatgacgagagggaaatctcagtatcagctgagtgccataggccacctaggcgcaaattccctccagctctcccaatatgggccaggcctgactacaatccacctcttatacaagcatggcaaatgcccgggtacgagcctccagtcgtgtctggatgcgccgtcgccccacctaagccggcaccaattcccccgccgaggcggaagaggctagtgcacttggatgagtccacggtctcgcacgccttggcacagcttgccgacaaggtatttgtggagagtagtagtgacccaggacctagttcagactcgggactatcaatagccagtcccgttccacctgccccaacaacaccagacgacgcctgctcagaagcagggtcctatagctcaatgccccctcttgagggggagcctggtgaccctgacctaagctcaggttcttggtccactgtgagcgatcaggacgacgtcgtgtgttgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 42 - DNA, 9633 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgcgctacctcatggttgcgcgacgtgtgggactgggtgtgtacagtgttatctgattttagagtatggctgaaagccaaactcctcccacgcctgccggggatccccttcctctcgtgccaaacgggatataggggagtctgggcaggggacggggtgtgccacaccacttgtacctgtggggccgtgatagctggacacgtcaaaaatggcaccatgaaaatcacagggcccaagacatgcagtaacacttggcacgggacttttccaatcaacgccaccactaccggccccagcacaccacgaccagcgccgaactatcagcgcgctctttggcgggtatctgccgaggactacgttgaagtacggaggttgggcgactgccactatgtggtaggggtcactgctgaagggctgaagtgcccttgccaggtgcctgcgcctgaattcttcactgaggtcgatggcgtgaggatacaccgttacgcgccaccttgtaagcccttgctcagggacgaagtgacattctctgtgggtctttcaagctatgccatagggtctcagctcccttgtgagccagagcctgacgtgaccgtagtcacctcaatgctcacagaccccacgcacatcaccgcagagacggcagcacggcggttgaagagggggtcccccccctccttagccagctcttcggccagccagctgtctgcaccgtccctcaaggctacttgcacaacatccaaagaccacccggacatggaactcattgaggccaacctcctttggaggcaggagatgggaggcaacatcactcgggtcgagtcggagaacaaagttgtaatacttgactcctttgagcctttaaccgctgagtatgacgagagggaaaactcagtatcagctgagtgccataggccacctaggcgcaaattccctccagctctcccaatatgggccaggcctgactacaatccacctcttatacaagcatggcaaatgcccgggtacgagcctccagtcgtgtctggatgcgccgtcgccccacctaagccggcaccaattcccccgccgaggcggaagaggctagtgcacttggatgagtccacggtctcgcacgccttggcacagcttgccgacaaggtatttgtggagagtagtagtgacccaggacctagttcagactcgggactatcaatagccagtcccgttccacctgccccaacaacaccagacgacgcctgctcagaagcagggtcctatagctcaatgccccctcttgagggggagcctggtgaccctgacctaagctcaggttcttggtccactgtgagcgatcaggacgacgtcgtgtgttgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 43 - DNA, 9618 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgcgccgggagctggctccgggaggtgtgggactgggtttgcatggtcctatccgactttgcatcttggttgaaggccaaggtacttcccagccttccagggatcccattcctatcctgtcagaaagggtataaaggtgagtggcggaacgatggcatcatgaacaccaagtgcccgtgtggggccctgatagcagggcacgtcaagaacggatcgatgcgcatcgtgggccccaagacctgccgaaacacctggtggggaaccttccctattaattcccataccacgggaccaagttctcctgtaccctcccactgttatcaaagggccttgtggagggtatctgcgacggagtacgtcgagatccttcgtcacaatgaccagcattacgtggtgggagtgacggcggaggacctcaagtgcccgtgtcaggttccttcccccgaattcttcagctttgtggacggggtgcggatacacagattcgcccctgaacccaagcccatgatccgggaagaagccgctttcgtggtgggtctgcactcatatgtggtggggtctcagctcccttgtgaaccggagccggacgtccaaactgtctcgcagctcctaaccgacccctcacacatcaccgcagaaaccgcggctagaaggctcaggagaggttcccccccatccaacgccagttcttctgctagtcaactctcagctccatctctaaaagccacccacacaactctgccacaacatcctgacgcagaactgatagaggccaacctcatgtgggaacataaggttggtgccatcagaaggatggagacagacaccaaagtcatcatacttgactcctttgattcagcttcttccgtcgaggatgacatggaaccgtccaccgccgcggagtgtctgcgtacgcgtaaggtcttcccaccggccatgcccatatgggcgaggccagactacaatcctcctgttgtggagaattggaaggaccccgagtacgcacctccccaggtgtctgggtgcgctctaccacctgcgcagacccctcctgttccaccacccaggcggaagcgggcggttatccaactcacagagtccgcggtttccacggcactggcggaactcgctgagaggtccttcccaaaggaggaggcaccccccagcgactccgccattagtctggattcaccggcggcaaatgaccctccatctgattgtgaccaaggcagtgagatctctttctcatccatgccacccctagagggggagccgggtgatccagacttgtctgatggctcttggtcaacagtcagcaccagatctgacgtgatttgctgttccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 44 - DNA, 9612 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacgaatcctaaacctcaaagaaaaaccaaacgtaacaccaaccgtcgcccacaggacgtcaagttcccgggtggcggtcagatcgttggtggagtttacttgttgccgcgcaggggccctagattgggtgtgcgcgcgacgaggaagacttccgagcggtcgcaacctcgaggtagacgtcagcctatccccaaggcacgtcggcccgagggcaggacctgggctcagcccgggtacccttggcccctctatggcaatgagggttgcgggtgggcgggatggctcctgtctccccgtggctctcggcctagctggggccccacagacccccggcgtaggtcgcgcaatttgggtaaggtcatcgatacccttacgtgcggcttcgccgacctcatggggtacataccgctcgtcggcgcccctcttggaggcgctgccagggccctggcgcatggcgtccgggttctggaagacggcgtgaactatgcaacagggaaccttcctggttgctctttctctatcttccttctggccctgctctcttgcctgactgtgcccgcttcagcctaccaagtgcgcaattcctcggggctttaccatgtcaccaatgattgccctaactcgagtattgtgtacgaggcggccgatgccatcctgcacactccggggtgtgtcccttgcgttcgcgagggtaacgcctcgaggtgttgggtggcggtgacccccacggtggccaccagggacggcaaactccccacaacgcagcttcgacgtcatatcgatctgcttgtcgggagcgccaccctctgctcggccctctacgtgggggacctgtgcgggtctgtctttcttgttggtcaactgtttaccttctctcccaggcgccactggacgacgcaagactgcaattgttctatctatcccggccatataacgggtcatcgcatggcatgggatatgatgatgaactggtcccctacggcagcgttggtggtagctcagctgctccggatcccacaagccatcatggacatgatcgctggtgctcactggggagtcctggcgggcatagcgtatttctccatggtggggaactgggcgaaggtcctggtagtgctgctgctatttgccggcgtcgacgcggaaacccacgtcaccgggggaaatgccggccgcaccacggctgggcttgttggtctccttacaccaggcgccaagcagaacatccaactgatcaacaccaacggcagttggcacatcaatagcacggccttgaattgcaatgaaagccttaacaccggctggttagcagggctcttctatcaacacaaattcaactcttcaggctgtcctgagaggttggccagctgccgacgccttaccgattttgcccagggctggggtcctatcagttatgccaacggaagcggcctcgacgaacgcccctactgctggcactaccctccaagaccttgtggcattgtgcccgcaaagagcgtgtgtggcccggtatattgcttcactcccagccccgtggtggtgggaacgaccgacaggtcgggcgcgcctacctacagctggggtgcaaatgatacggatgtcttcgtccttaacaacaccaggccaccgctgggcaattggttcggttgtacctggatgaactcaactggattcaccaaagtgtgcggagcgcccccttgtgtcatcggaggggtgggcaacaacaccttgctctgccccactgattgcttccgcaaacatccggaagccacatactctcggtgcggctccggtccctggattacacccaggtgcatggtcgactacccgtataggctttggcactatccttgtaccatcaattacaccatattcaaagtcaggatgtacgtgggaggggtcgagcacaggctggaagcggcctgcaactggacgcggggcgaacgctgtgatctggaagacagggacaggtccgagctcagcccgttgctgctgtccaccacacagtggcaggtccttccgtgttctttcacgaccctgccagccttgtccaccggcctcatccacctccaccagaacattgtggacgtgcagtacttgtacggggtagggtcaagcatcgcgtcctgggccattaagtgggagtacgtcgttctcctgttccttctgcttgcagacgcgcgcgtctgctcctgcttgtggatgatgttactcatatcccaagcggaggcggctttggagaacctcgtaatactcaatgcagcatccctggccgggacgcacggtcttgtgtccttcctcgtgttcttctgctttgcgtggtatctgaagggtaggtgggtgcccggagcggcctacgccctctacgggatgtggcctctcctcctgctcctgctggcgttgcctcagcgggcatacgcactggacacggaggtggccgcgtcgtgtggcggcgttgttcttgtcgggttaatggcgctgactctgtcgccatattacaagcgctatatcagctggtgcatgtggtggcttcagtattttctgaccagagtagaagcgcaactgcacgtgtgggttccccccctcaacgtccggggggggcgcgatgccgtcatcttactcatgtgtgtagtacacccgaccctggtatttgacatcaccaaactactcctggccatcttcggacccctttggattcttcaagccagtttgcttaaagtcccctacttcgtgcgcgttcaaggccttctccggatctgcgcgctagcgcggaagatagccggaggtcattacgtgcaaatggccatcatcaagttaggggcgcttactggcacctatgtgtataaccatctcacccctcttcgagactgggcgcacaacggcctgcgagatctggccgtggctgtggaaccagtcgtcttctcccgaatggagaccaagctcatcacgtggggggcagataccgccgcgtgcggtgacatcatcaacggcttgcccgtctctgcccgtaggggccaggagatactgcttgggccagccgacggaatggtctccaaggggtggaggttgctggctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgccctggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggttcctggctaagggacatctgggactggatatgcgaggtgctgagcgactttaagacctggctgaaagccaagctcatgccacaactgcctgggattccctttgtgtcctgccagcgcgggtataggggggtctggcgaggagacggcattatgcacactcgctgccactgtggagctgagatcactggacatgtcaaaaacgggacgatgaggatcgtcggtcctaggacctgcaggaacatgtggagtgggacgttccccattaacgcctacaccacgggcccctgtactccccttcctgcgccgaactataagttcgcgctgtggagggtgtctgcagaggaatacgtggagataaggcgggtgggggacttccactacgtatcgggtatgactactgacaatcttaaatgcccgtgccagatcccatcgcccgaatttttcacagaattggacggggtgcgcctacacaggtttgcgcccccttgcaagcccttgctgcgggaggaggtatcattcagagtaggactccacgagtacccggtggggtcgcaattaccttgcgagcccgaaccggacgtagccgtgttgacgtccatgctcactgatccctcccatataacagcagaggcggccgggagaaggttggcgagagggtcacccccttctatggccagctcctcggctagccagctgtccgctccatctctcaaggcaacttgcaccgccaaccatgactcccctgacgccgagctcatagaggctaacctcctgtggaggcaggagatgggcggcaacatcaccagggttgagtcagagaacaaagtggtgattctggactccttcgatccgcttgtggcagaggaggatgagcgggaggtctccgtacctgcagaaattctgcggaagtctcggagattcgcccgggccctgcccgtctgggcgcggccggactacaaccccccgctagtagagacgtggaaaaagcctgactacgaaccacctgtggtccatggctgcccgctaccacctccacggtcccctcctgtgcctccgcctcggaaaaagcgtacggtggtcctcaccgaatcaaccctatctactgccttggccgagcttgccaccaaaagttttggcagctcctcaacttccggcattacgggcgacaatacgacaacatcctctgagcccgccccttctggctgcccccccgactccgacgttgagtcctattcttccatgccccccctggagggggagcctggggatccggatctcagcgacgggtcatggtcgacggtcagtagtggggccgacacggaagatgtcgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 45 - DNA, 9612 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacgaatcctaaacctcaaagaaaaaccaaacgtaacaccaaccgtcgcccacaggacgtcaagttcccgggtggcggtcagatcgttggtggagtttacttgttgccgcgcaggggccctagattgggtgtgcgcgcgacgaggaagacttccgagcggtcgcaacctcgaggtagacgtcagcctatccccaaggcacgtcggcccgagggcaggacctgggctcagcccgggtacccttggcccctctatggcaatgagggttgcgggtgggcgggatggctcctgtctccccgtggctctcggcctagctggggccccacagacccccggcgtaggtcgcgcaatttgggtaaggtcatcgatacccttacgtgcggcttcgccgacctcatggggtacataccgctcgtcggcgcccctcttggaggcgctgccagggccctggcgcatggcgtccgggttctggaagacggcgtgaactatgcaacagggaaccttcctggttgctctttctctatcttccttctggccctgctctcttgcctgactgtgcccgcttcagcctaccaagtgcgcaattcctcggggctttaccatgtcaccaatgattgccctaactcgagtattgtgtacgaggcggccgatgccatcctgcacactccggggtgtgtcccttgcgttcgcgagggtaacgcctcgaggtgttgggtggcggtgacccccacggtggccaccagggacggcaaactccccacaacgcagcttcgacgtcatatcgatctgcttgtcgggagcgccaccctctgctcggccctctacgtgggggacctgtgcgggtctgtctttcttgttggtcaactgtttaccttctctcccaggcgccactggacgacgcaagactgcaattgttctatctatcccggccatataacgggtcatcgcatggcatgggatatgatgatgaactggtcccctacggcagcgttggtggtagctcagctgctccggatcccacaagccatcatggacatgatcgctggtgctcactggggagtcctggcgggcatagcgtatttctccatggtggggaactgggcgaaggtcctggtagtgctgctgctatttgccggcgtcgacgcggaaacccacgtcaccgggggaaatgccggccgcaccacggctgggcttgttggtctccttacaccaggcgccaagcagaacatccaactgatcaacaccaacggcagttggcacatcaatagcacggccttgaattgcaatgaaagccttaacaccggctggttagcagggctcttctatcaacacaaattcaactcttcaggctgtcctgagaggttggccagctgccgacgccttaccgattttgcccagggctggggtcctatcagttatgccaacggaagcggcctcgacgaacgcccctactgctggcactaccctccaagaccttgtggcattgtgcccgcaaagagcgtgtgtggcccggtatattgcttcactcccagccccgtggtggtgggaacgaccgacaggtcgggcgcgcctacctacagctggggtgcaaatgatacggatgtcttcgtccttaacaacaccaggccaccgctgggcaattggttcggttgtacctggatgaactcaactggattcaccaaagtgtgcggagcgcccccttgtgtcatcggaggggtgggcaacaacaccttgctctgccccactgattgcttccgcaaacatccggaagccacatactctcggtgcggctccggtccctggattacacccaggtgcatggtcgactacccgtataggctttggcactatccttgtaccatcaattacaccatattcaaagtcaggatgtacgtgggaggggtcgagcacaggctggaagcggcctgcaactggacgcggggcgaacgctgtgatctggaagacagggacaggtccgagctcagcccgttgctgctgtccaccacacagtggcaggtccttccgtgttctttcacgaccctgccagccttgtccaccggcctcatccacctccaccagaacattgtggacgtgcagtacttgtacggggtagggtcaagcatcgcgtcctgggccattaagtgggagtacgtcgttctcctgttccttctgcttgcagacgcgcgcgtctgctcctgcttgtggatgatgttactcatatcccaagcggaggcggctttggagaacctcgtaatactcaatgcagcatccctggccgggacgcacggtcttgtgtccttcctcgtgttcttctgctttgcgtggtatctgaagggtaggtgggtgcccggagcggcctacgccctctacgggatgtggcctctcctcctgctcctgctggcgttgcctcagcgggcatacgcactggacacggaggtggccgcgtcgtgtggcggcgttgttcttgtcgggttaatggcgctgactctgtcgccatattacaagcgctatatcagctggtgcatgtggtggcttcagtattttctgaccagagtagaagcgcaactgcacgtgtgggttccccccctcaacgtccggggggggcgcgatgccgtcatcttactcatgtgtgtagtacacccgaccctggtatttgacatcaccaaactactcctggccatcttcggacccctttggattcttcaagccagtttgcttaaagtcccctacttcgtgcgcgttcaaggccttctccggatctgcgcgctagcgcggaagatagccggaggtcattacgtgcaaatggccatcatcaagttaggggcgcttactggcacctatgtgtataaccatctcacccctcttcgagactgggcgcacaacggcctgcgagatctggccgtggctgtggaaccagtcgtcttctcccgaatggagaccaagctcatcacgtggggggcagataccgccgcgtgcggtgacatcatcaacggcttgcccgtctctgcccgtaggggccaggagatactgcttgggccagccgacggaatggtctccaaggggtggaggttgctggctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgagctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgccctggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggttcctggctaagggacatctgggactggatatgcgaggtgctgagcgactttaagacctggctgaaagccaagctcatgccacaactgcctgggattccctttgtgtcctgccagcgcgggtataggggggtctggcgaggagacggcattatgcacactcgctgccactgtggagctgagatcactggacatgtcaaaaacgggacgatgaggatcgtcggtcctaggacctgcaggaacatgtggagtgggacgttccccattaacgcctacaccacgggcccctgtactccccttcctgcgccgaactataagttcgcgctgtggagggtgtctgcagaggaatacgtggagataaggcgggtgggggacttccactacgtatcgggtatgactactgacaatcttaaatgcccgtgccagatcccatcgcccgaatttttcacagaattggacggggtgcgcctacacaggtttgcgcccccttgcaagcccttgctgcgggaggaggtatcattcagagtaggactccacgagtacccggtggggtcgcaattaccttgcgagcccgaaccggacgtagccgtgttgacgtccatgctcactgatccctcccatataacagcagaggcggccgggagaaggttggcgagagggtcacccccttctatggccagctcctcggctagccagctgtccgctccatctctcaaggcaacttgcaccgccaaccatgactcccctgacgccgagctcatagaggctaacctcctgtggaggcaggagatgggcggcaacatcaccagggttgagtcagagaacaaagtggtgattctggactccttcgatccgcttgtggcagaggaggatgagcgggaggtctccgtacctgcagaaattctgcggaagtctcggagattcgcccgggccctgcccgtctgggcgcggccggactacaaccccccgctagtagagacgtggaaaaagcctgactacgaaccacctgtggtccatggctgcccgctaccacctccacggtcccctcctgtgcctccgcctcggaaaaagcgtacggtggtcctcaccgaatcaaccctatctactgccttggccgagcttgccaccaaaagttttggcagctcctcaacttccggcattacgggcgacaatacgacaacatcctctgagcccgccccttctggctgcccccccgactccgacgttgagtcctattcttccatgccccccctggagggggagcctggggatccggatctcagcgacgggtcatggtcgacggtcagtagtggggccgacacggaagatgtcgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 46 - DNA, 9612 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacgaatcctaaacctcaaagaaaaaccaaacgtaacaccaaccgtcgcccacaggacgtcaagttcccgggtggcggtcagatcgttggtggagtttacttgttgccgcgcaggggccctagattgggtgtgcgcgcgacgaggaagacttccgagcggtcgcaacctcgaggtagacgtcagcctatccccaaggcgcgtcggcccgagggcaggacctgggctcagcccgggtacccttggcccctctatggcaatgagggttgcgggtgggcgggatggctcctgtctccccgtggctctcggcctagctggggccccacggacccccggcgtaggtcgcgcaatttgggtaaggtcatcgatacccttacgtgcggcttcgccgacctcatggggtacataccgctcgtcggcgcccctcttggaggcgctgccagggccctggcgcatggcgtccgggttttggaagacggcgtgaactatgcaacagggaaccttcctggttgctctttctctattttccttctggccctgctctcttgtctgactggacccgcttcagcctaccaagtgcgcaactccacggggctttaccatgtcaccaatgattgccccaactcgagcattgtgttcgaggcggctgatgccatcctgcacactccggggtgtgtcccttgcgtacgcgagggtaacgcctcgaggtgttgggtggcggtaacccccacggtggccaccagggatggcaaactccccacaacgcagcttcgacgtcacatcgatctgcttgtcgggagcgccaccctctgctcggccctttacgtgggggacctgtgcgggtctgtctttcttgttggtcaactgttcaccttctctcccaggcgccactggacgacgcaagattgcaattgttctatctaccccggccatatttcaggtcaccgtatggcatgggatatgatgatgaactggtcccctacggcggcgttgttggtagctcagctgctccggatcccacaagccatcctggacatgatcgctggtgctcactggggagtcctggcgggcatggcgtatttctccatggtggggaactgggcgaaggttctggtagtgctgctgctatttgccggcgtcgacgcggaaacctacgtcaccgggggaagtgccgcccgtactacggctggacttgctagtcttttctcaccaggcgccaagcagaacatccagctggtcaacaccaacggcagttggcacatcaatagcacggccttgaactgcaatgacagcctcaacaccggctggatagcaggacttttctatcaccacaaattcaactcttcgggctgttccgagaggttagccagctgccgaccccttaccgattttgcccagggctggggccctatcagtcacgccgacggaagtggccccgaccaacgcccctactgctggcactaccctccaaaaccttgtggtattgtgcccgcaaagagcgtgtgtggcccggtatattgtttcactcccagtcccgtggtggtgggaacgaccgacaggtcgggcgcgcctacctacagctggggtgcaaatgacacggacgtcttcgtccttaacaacaccaggccaccgctgggcaattggttcggttgcacctggatgaactcaactggattcaccaaagtgtgcggagcgcccccttgcgtcatcggaggggtgggcaacaacaccttgcgctgccccactgattgtttccgcaagcatccggaagccacatactctcggtgcggctccggtccctggattacgcccaggtgcctggtcgactacccgtataggctttggcattatccttgtaccatcaactacaccgtgtttaaagtcaggatgtacgtgggaggggtcgagcacaggctggaagctgcctgcaactggacgcggggcgaccgttgtaatctggatgacagggacaggtccgagctcagcccgctgctgctgtccactacgcagtggcaggtcctcccgtgttccttcacgaccctgccagccttgtccaccggcctcatccacctccaccaaaacatcgtggacgtgcaatacttgtacggggtgggatcaagcatcgcgtcctgggccatcaagtgggaatacgtcgttctcttgttccttctgcttgcagacgcgcgcgtctgctcctgcttgtggatgatgttactcatatcccaagtggaggcggctttggagaacctcgtagtactcaatgcagcatccctggccgggacacacggtcttgtatccttcctcgtgttcttctgctttgcatggtatctgaagggtaagtgggtgcccggagcggtctacgccctctacgggatgtggcctctcctcttgctcctgttagcgttgccccagcgggcatacgcactggacacggaggtggccgcgtcgtgtggcggcgttgttcttgtcgggttaatggcgctgactctgtcaccatattacaagcgctatatcagctggtgcttgtggtggcttcagtatttcctgaccagaatagaagcgcaactgcacgtgtggattccccctctcaacgtccggggggggcgcgatgccgtcatcttactcatgtgtgttgtgcacccggctctggtatttgacatcaccaagctactgctggctgccttcgggcccctttggattcttcaagccagtttgcttaaggtaccctacttcgtgcgcgttcaaggccttctccggatctgcgcgctagcgcggaagatggctggaggccattacgtgcaaatggccatcatcaagttaggggcgcttactggcacttatgtttacaaccatctcaccccccttcgggactgggcgcacaacggcctgcgagatctggccgtggctgtggagccagtcgtcttctcccgaatggagaccaagcttatcacctggggggcagacaccgccgcgtgcggtgacatcatcaacggcttgcccgtctccgcccggaggggccgggagatactgctcgggccagccgatggaatggtctccaaggggtggagattgctggctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggccctttggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggttcctggctgagggacatctgggactggatatgcgaggtgctgagcgactttaagacctggctgaaagccaagctcatgccgcaactgcctgggattccctttgtgtcctgccagcgtgggtataagggggtctggcgaggggacggcatcatgcacactcgctgccactgtggagctgagataactggacatgtcaaaaacgggacgatgaggatcgttggtcctaagacttgcaggaacatgtggagtgggactttccccattaacgcctacaccacgggcccctgtactccccttcctgcgccgaactatacgttcgcgctgtggagggtgtctgcagaggaatacgtggagataaggcaggtgggggacttccactacgtgacgggtatgactactgacaaccttaaatgcccgtgccaggtcccatcgcccgaatttttcacagaattggacggggtgcgcctacataggtttgcgcccccttgcaagcccctgctgcgggaggaggtgtcattcagagtgggactccacgagtacccggtggggtcgcaattaccttgcgagcccgaaccggacgtggccgtgttgacgtccatgctcactgatccctcccatataacagcagaggcggccgggagaaggttggcgaggggatcacccccctctatggccagctcctcggctagccaactgtccgctccatctctcagggcaacttgcactaccaaccatgactcccctgatgctgagctcatagaggccaacctcctatggaggcaggagatgggcggcaacatcaccagggttgagtcagagaacaaagtggtgattctggactccttcgatccgcttgtggcagaggaggatgagcgggaggtctccgtgcccgcagagatactgcggaagtctcggaaattcaccccagccctacccatttgggcgcggccggactataaccccccgctggtggagccgtggaaaaagcctgactacgaaccacctgtggtccatggctgcccgcttccacctccacagtcccctcctgtgcctccacctcggaagaagcggacggtgatcctcaccgaatcaaccctacctactgccttggccgagcttgccaccaaaagttttggcagctcctcaacttccggcattacgggcgacgacacgacaacatcccctgagcccgcctcctctagctgccctcccgactccgacgctgagtcctattcttccatgccccctctggagggggagcctggggatccggatctcagcgacgggtcatggtcgacggtcagtagtgaggccgacaaggaggatgtcgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 47 - DNA, 9609 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacgaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaaggcttccgagcggtcgcaacctcgtggaaggcgacaacctatcccaaaggctcgccgacccgagggcagggcctgggctcagcccgggtacccttggcccctctatggcaatgagggcctggggtgggcaggatggctcctgtcaccccgcggctcccggcctagttggggccccacggacccccggcgtaggtcgcgtaacttgggtaaggtcatcgatacccttacatgcggcttcgccgatctcatggggtacattccgctcgtcggcgcccccctagggggcgctgccagggccttggcacacggtgtccgggttctggaggacggcgtgaactatgcaacagggaacttgcccggttgctctttctctatcttcctcttggctctgctgtcctgtttgaccatcccagcttccgcttatgaagtgcgcaacgtgtccgggatataccatgtcacgaacgactgctccaactcaagcattgtgtatgaggcagcggacgtgatcatgcatactcccgggtgcgtgccctgtgttcaggagggtaacagctcccgttgctgggtagcgctcactcccacgctcgcggccaggaatgccagcgtccccactacgacaatacgacgccacgtcgacttgctcgttgggacggctgctttctgctccgctatgtacgtgggggatctctgcggatctattttcctcgtctcccagctgttcaccttctcgcctcgccggcatgagacagtgcaggactgcaactgctcaatctatcccggccatgtatcaggtcaccgcatggcttgggatatgatgatgaactggtcacctacaacagccctagtggtgtcgcagttgctccggatcccacaagctgtcgtggacatggtggcgggggcccactggggagtcctggcgggccttgcctactattccatggtagggaactgggctaaggttctgattgtggcgctactctttgccggcgttgacggggagacccacacgacggggagggtggccggccacaccacctccgggttcacgtcccttttctcatctggggcgtctcagaaaatccagcttgtgaataccaacggcagctggcacatcaacaggactgccctaaattgcaatgactccctccaaactgggttctttgccgcgctgttttacgcacacaagttcaactcgtccgggtgcccggagcgcatggccagctgccgccccattgactggttcgcccaggggtggggccccatcacctatactaagcctaacagctcggatcagaggccttattgctggcattacgcgcctcgaccgtgtggtgtcgtacccgcgtcgcaggtgtgtggtccagtgtattgtttcaccccaagccctgttgtggtggggaccaccgatcgttccggtgtccctacgtatagctggggggagaatgagacagacgtgatgctcctcaacaacacgcgtccgccacaaggcaactggttcggctgtacatggatgaatagtactgggttcactaagacgtgcggaggtcccccgtgtaacatcgggggggtcggtaaccgcaccttgatctgccccacggactgcttccggaagcaccccgaggctacttacacaaaatgtggctcggggccctggttgacacctaggtgcctagtagactacccatacaggctttggcactacccctgcactctcaatttttccatctttaaggttaggatgtatgtggggggcgtggagcacaggctcaatgccgcatgcaattggactcgaggagagcgctgtaacttggaggacagggataggtcagaactcagcccgctgctgctgtctacaacagagtggcagatactgccctgtgctttcaccaccctaccggctttatccactggtttgatccatctccatcagaacatcgtggacgtgcaatacctgtacggtgtagggtcagcgtttgtctcctttgcaatcaaatgggagtacatcctgttgcttttccttctcctggcagacgcgcgcgtgtgtgcctgcttgtggatgatgctgctgatagcccaggctgaggccgccttagagaacttggtggtcctcaatgcggcgtccgtggccggagcgcatggtattctctcctttcttgtgttcttctgcgccgcctggtacattaagggcaggctggctcctggggcggcgtatgctttttatggcgtatggccgctgctcctgctcctactggcgttaccaccacgagcttacgccttggaccgggagatggctgcatcgtgcgggggtgcggttcttgtaggtctggtattcttgaccttgtcaccatactacaaagtgtttctcactaggctcatatggtggttacaatactttatcaccagagccgaggcgcacatgcaagtgtgggtcccccccctcaacgttcggggaggccgcgatgccatcatcctcctcacgtgtgcggttcatccagagttaattcttgacatcaccaaactcctgctcgccatactcggcccgctcatggtgctccaggctggcataacgagagtgccgtacttcgtgcgcgctcaagggctcattcgtgcatgcatgttagtgcgaaaagtcgccgggggtcattatgtccaaatggtcttcatgaagctgggcgcgctgacaggtacgtacgtttataaccatcttaccccactgcgggactgggcccacgcgggcctacgagaccttgcggtggcggtagagcccgtcgtcttctccgccatggagaccaaggtcatcacctggggagcagacaccgctgcgtgtggggacatcatcttgggtctacccgtctccgcccgaagggggaaggagatatttttgggaccggctgatagtctcgaagggcaagggtggcgactccttgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagactgggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggctcgtggctaagggatgtttgggattggatatgcacggtgttgactgacttcaagacctggctccagtccaaactcctgccgcggttaccgggagtccctttcctgtcatgccaacgcgggtacaagggagtctggcggggggacggcatcatgcaaaccacctgcccatgcggagcacagatcgccggacatgtcaaaaacggttccatgaggatcgtagggcctagaacctgcagcaacacgtggcacggaacgttccccatcaacgcatacaccacgggaccttgcacaccctccccggcgcccaactattccagggcgctatggcgggtggctgctgaggagtacgtggaggttacgcgtgtgggggatttccactacgtgacgggcatgaccactgacaacgtaaagtgcccatgccaggttccggcccccgaattcttcacggaggtggatggagtgcggttgcacaggtacgctccggcgtgcaaacctcttctacgggaggacgtcacgttccaggtcgggctcaaccaatacttggtcgggtcgcagctcccatgcgagcccgaaccggacgtaacagtgcttacttccatgctcaccgatccctcccacattacagcagagacggctaagcgtaggctggctagagggtctcccccctctttagccagctcatcagctagccagttgtctgcgccttctttgaaggcgacatgcactacccaccatgactccccggacgctgacctcatcgaggccaacctcttgtggcggcaggagatgggcggaaacatcactcgcgtggagtcagagaataaggtagtaattctggactctttcgaaccgcttcacgcggagggggatgagagggagatatccgtcgcggcggagatcctgcgaaaatccaggaagttcccctcagcgttgcccatatgggcacgcccggactacaatcctccactgctagagtcctggaaggacccggactacgtccctccggtggtacacggatgcccattgccacctaccaaggctcctccaataccacctccacggagaaagaggacggttgtcctgacagaatccaatgtgtcttctgccttggcggagctcgccactaagaccttcggtagctccggatcgtcggccgttgatagcggcacggcgaccgcccttcctgacctggcctccgacgacggtgacaaaggatccgacgttgagtcgtactcctccatgcccccccttgaaggggagccgggggaccccgatctcagcgacgggtcttggtctaccgtgagtgaggaggctagtgaggatgtcgtctgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 48 - DNA, 9609 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacgaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaaggcttccgagcggtcgcaacctcgtggaaggcgacaacctatcccaaaggctcgccgacccgagggcagggcctgggctcagcccgggtacccttggcccctctatggcaatgagggcctggggtgggcaggatggctcctgtcaccccgcggctcccggcctagttggggccccacggacccccggcgtaggtcgcgtaacttgggtaaggtcatcgatacccttacatgcggcttcgccgatctcatggggtacattccgctcgtcggcgcccccctagggggcgctgccagggccttggcacacggtgtccgggttctggaggacggcgtgaactatgcaacagggaacttgcccggttgctctttctctatcttcctcttggctctgctgtcctgtttgaccatcccagcttccgcttatgaagtgcgcaacgtgtccgggatataccatgtcacgaacgactgctccaactcaagcattgtgtatgaggcagcggacgtgatcatgcatactcccgggtgcgtgccctgtgttcaggagggtaacagctcccgttgctgggtagcgctcactcccacgctcgcggccaggaatgccagcgtccccactacgacaatacgacgccacgtcgacttgctcgttgggacggctgctttctgctccgctatgtacgtgggggatctctgcggatctattttcctcgtctcccagctgttcaccttctcgcctcgccggcatgagacagtgcaggactgcaactgctcaatctatcccggccatgtatcaggtcaccgcatggcttgggatatgatgatgaactggtcacctacaacagccctagtggtgtcgcagttgctccggatcccacaagctgtcgtggacatggtggcgggggcccactggggagtcctggcgggccttgcctactattccatggtagggaactgggctaaggttctgattgtggcgctactctttgccggcgttgacggggagacccacacgacggggagggtggccggccacaccacctccgggttcacgtcccttttctcatctggggcgtctcagaaaatccagcttgtgaataccaacggcagctggcacatcaacaggactgccctaaattgcaatgactccctccaaactgggttctttgccgcgctgttttacgcacacaagttcaactcgtccgggtgcccggagcgcatggccagctgccgccccattgactggttcgcccaggggtggggccccatcacctatactaagcctaacagctcggatcagaggccttattgctggcattacgcgcctcgaccgtgtggtgtcgtacccgcgtcgcaggtgtgtggtccagtgtattgtttcaccccaagccctgttgtggtggggaccaccgatcgttccggtgtccctacgtatagctggggggagaatgagacagacgtgatgctcctcaacaacacgcgtccgccacaaggcaactggttcggctgtacatggatgaatagtactgggttcactaagacgtgcggaggtcccccgtgtaacatcgggggggtcggtaaccgcaccttgatctgccccacggactgcttccggaagcaccccgaggctacttacacaaaatgtggctcggggccctggttgacacctaggtgcctagtagactacccatacaggctttggcactacccctgcactctcaatttttccatctttaaggttaggatgtatgtggggggcgtggagcacaggctcaatgccgcatgcaattggactcgaggagagcgctgtaacttggaggacagggataggtcagaactcagcccgctgctgctgtctacaacagagtggcagatactgccctgtgctttcaccaccctaccggctttatccactggtttgatccatctccatcagaacatcgtggacgtgcaatacctgtacggtgtagggtcagcgtttgtctcctttgcaatcaaatgggagtacatcctgttgcttttccttctcctggcagacgcgcgcgtgtgtgcctgcttgtggatgatgctgctgatagcccaggctgaggccgccttagagaacttggtggtcctcaatgcggcgtccgtggccggagcgcatggtattctctcctttcttgtgttcttctgcgccgcctggtacattaagggcaggctggctcctggggcggcgtatgctttttatggcgtatggccgctgctcctgctcctactggcgttaccaccacgagcttacgccttggaccgggagatggctgcatcgtgcgggggtgcggttcttgtaggtctggtattcttgaccttgtcaccatactacaaagtgtttctcactaggctcatatggtggttacaatactttatcaccagagccgaggcgcacatgcaagtgtgggtcccccccctcaacgttcggggaggccgcgatgccatcatcctcctcacgtgtgcggttcatccagagttaattcttgacatcaccaaactcctgctcgccatactcggcccgctcatggtgctccaggctggcataacgagagtgccgtacttcgtgcgcgctcaagggctcattcgtgcatgcatgttagtgcgaaaagtcgccgggggtcattatgtccaaatggtcttcatgaagctgggcgcgctgacaggtacgtacgtttataaccatcttaccccactgcgggactgggcccacgcgggcctacgagaccttgcggtggcggtagagcccgtcgtcttctccgccatggagaccaaggtcatcacctggggagcagacaccgctgcgtgtggggacatcatcttgggtctacccgtctccgcccgaagggggaaggagatatttttgggaccggctgatagtctcgaagggcaagggtggcgactccttgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgagctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagactgggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggctcgtggctaagggatgtttgggattggatatgcacggtgttgactgacttcaagacctggctccagtccaaactcctgccgcggttaccgggagtccctttcctgtcatgccaacgcgggtacaagggagtctggcggggggacggcatcatgcaaaccacctgcccatgcggagcacagatcgccggacatgtcaaaaacggttccatgaggatcgtagggcctagaacctgcagcaacacgtggcacggaacgttccccatcaacgcatacaccacgggaccttgcacaccctccccggcgcccaactattccagggcgctatggcgggtggctgctgaggagtacgtggaggttacgcgtgtgggggatttccactacgtgacgggcatgaccactgacaacgtaaagtgcccatgccaggttccggcccccgaattcttcacggaggtggatggagtgcggttgcacaggtacgctccggcgtgcaaacctcttctacgggaggacgtcacgttccaggtcgggctcaaccaatacttggtcgggtcgcagctcccatgcgagcccgaaccggacgtaacagtgcttacttccatgctcaccgatccctcccacattacagcagagacggctaagcgtaggctggctagagggtctcccccctctttagccagctcatcagctagccagttgtctgcgccttctttgaaggcgacatgcactacccaccatgactccccggacgctgacctcatcgaggccaacctcttgtggcggcaggagatgggcggaaacatcactcgcgtggagtcagagaataaggtagtaattctggactctttcgaaccgcttcacgcggagggggatgagagggagatatccgtcgcggcggagatcctgcgaaaatccaggaagttcccctcagcgttgcccatatgggcacgcccggactacaatcctccactgctagagtcctggaaggacccggactacgtccctccggtggtacacggatgcccattgccacctaccaaggctcctccaataccacctccacggagaaagaggacggttgtcctgacagaatccaatgtgtcttctgccttggcggagctcgccactaagaccttcggtagctccggatcgtcggccgttgatagcggcacggcgaccgcccttcctgacctggcctccgacgacggtgacaaaggatccgacgttgagtcgtactcctccatgcccccccttgaaggggagccgggggaccccgatctcagcgacgggtcttggtctaccgtgagtgaggaggctagtgaggatgtcgtctgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 49 - DNA, 9642 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacacttcctaaacctcaaagaaaaaccaaaagaaacaccatccgtcgcccacaggacgttaagttcccgggtggcggacagatcgttggtggagtatacgtgttgccgcgcaggggcccacgattgggtgtgcgcgcgacgcgtaaaacttctgaacggtcacagcctcgcggacgacgacagcctatccccaaggcgcgtcggagcgaaggccggtcctgggctcagcccgggtacccttggcccctctatggtaatgagggctgcgggtgggcagggtggctcctgtccccgcgcggctcccgtccatcttggggcccaaacgacccccggcggaggtcccgcaatttgggtaaagtcatcgatacccttacgtgcggattcgccgacctcatggggtacatcccgctcgtcggcgctcccgtaggaggcgtcgcaagagccctcgcgcatggcgtgagggcccttgaagacgggataaattttgcaacagggaacttgcccggttgctccttttctatcttccttcttgctctgttctcctgcttagttcatcctgcagctagtcttgagtggcggaatacgtctggcctctatgtccttaccaacgactgttccaatagcagtattgtgtatgaggccgatgacgtcattctgcacacacccggctgtgtaccttgtgttcaggacgacaatacatccacgtgctggaccccagtgacacctacggtggcagtcaggtacgtcggagcaaccaccgcttcgatacgcagtcatgtggacctattagtgggcgcggccacgctgtgctctgcgctctatgtgggtgatatgtgtggggccgtctttctcgtgggacaagccttcacgttcagacctcgtcgccatcaaacggtccagacctgtaactgctcgctgtacccaggccatgtttcaggacatcgaatggcttgggatatgatgatgaattggtcccccgctgtgggtatggtggtggcgcacatcctgcgattgccccagaccttgtttgacatactggccggggcccattggggcatcttggcgggcctagcctattattctatgcagggcaactgggccaaggtcgctattgtcatgattatgttttcaggggtcgatgctgaaacatatgtcaccggtggcagtgtagctcatagtgccagagggttaactagcctttttagtatgggcgccaagcagaaactgcaattggtcaacaccaatggctcgtggcacatcaacagtactgccctgaactgcaatgagtccataaacaccgggttcatagctgggttgttttattaccataagttcaactctactggatgtcctcaaaggcttagcagctgcaagcccatcatttccttcaggcaggggtggggccccttgacagatgctaacatcaccggtccttctgatgatagaccgtattgctggcactacgcacctagaccttgtagtgttgtcccggcatcaagtgtctgcggccctgtgtactgcttcacaccatcgccagtggtcgtaggcactactgatatcaaaggcaagccgacctacaactggggtgagaatgagacagatgtgttcctgctggagtccctgcggcctcccagtggccggtggtttggatgcgcgtggatgaactccacggggttcctcaagacgtgtggagctcccccttgtaacatctatgggggtgagggggatcccgaaaatgagacagacctcttctgccccaccgactgcttcaggaaacatcctgaggccacatacagccggtgtggtgcggggccctggttgacacctcgctgcatggtcgactatccataccggctttggcattacccatgtacagtcaatttcacattgttcaaggtgaggatgtttgtgggcggatttgaacaccggtttaccgccgcttgtaactggaccaggggggagcgctgcaatatcgaggatcgtgatcgcagcgagcaacatccgctgctgcattcaacaactgagcttgctatactgccttgctctttcacgcccatgcctgcattgtcaacaggtctaatacacctccaccaaaatatcgtggatgtccaatacctttatggtgttggatctgacatggtgggatgggcgctgaaatgggagttcgtcatcctcgttttcctcctcctggcagacgcacgcgtgtgcgttgccctttggctgatgctgatggtatcacaagcagaagcagccttggagaaccttgtcacgctgaacgccgtcgctgctgctgggacacatggtattggttggtacctggtagccttttgcgcggcgtggtacgtgcggggtaaacttgtcccgctgacgagctacggcctgacgggtctttggtccctagcattgcttgtcctcttgctcccccaacgggcgtatgcttggtcgggtgaagacagcgctactctcggcgctggggtcttggccctcttcggcttctttaccttatcaccctggtacaagcattggatcggccgcctcatgtggtggaaccagtacactatatgtagatgcgaggccgcccttcaagtgtgggtcccccccttacttgcacgcgggagtagggacggtgtcatcctgctaacaagcttgctttatccatccttaatttttgacatcactaagctgctgatagcagtaataggcccattatacttaatacaggctgccatcactaccaccccctactttgtgcgcgcacatgtactggtccgcctttgcatgctcgtgcgctccgtgatggggggaaagtacttccagatggccatactgagcattggcagatggttcaacacctacctatatgaccacctagcgccaatgcaacattgggccgcagctggcctcaaagacctagcagtggccactgaacctgtaatatttagtcccatggaaattaaggtcatcacctggggcgcggacacagcggcttgcggagatattctttgcgggctgccggtctccgcgcgattaggccgtgaggtattgttgggacctgctgatgattatcgggaaatgggttggcgtctgttggctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagcaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgcagcggcgattggctgcgtgacatctgggactgggtttgctcggtgttgtccgacttcaagacgtggctctctgctaagattatgccagcactccctgggctgcccttcatctcctgtcaaaagggatacaagggcgtgtggcggggggatggtgtgatgtcgacacgctgtccttgcggggcatcaatcactggccacgtgaagaatgggtccatgcggcttgcggggccgcgtatgtgtgctaacatgtggcacggtactttccccatcaatgagtacaccaccggacccagcacaccttgcccatcacccaactacactcgcgcactatggcgcgtggctgccagcagctacgttgaggtgcgccgggtgggggacttccattatattacgggggctacagaagatgagctcaagtgtccgtgccaagtgccggctgctgagttctttactgaagtggatggggtgagactccaccgttacgcccctccatgtaagcccctgttgagagaagagatcactttctcggtagggttgcattcctacgcgataggatctcaactcccctgtgagccagaaccagatgtttctgtgttgacctcgatgttgagagacccttctcatatcaccgccgagacggcagcgcgccgccttgcgcgcgggtcccctccatcagaggcaagctcatccgccagccaactatcggctccgtcgttgaaggccacttgccagacgcataggcctcatccagacgctgagctggtggacgccaacttgttatggcggcaagagatgggcagcaacattacacgggtggagtctgaaacgaaggttgtgattcttgattcattcgaacctctgagagccgaagctgacgacgccgagctctcggtggctgcagagtgtttcaagaagcctcccaagtatcctccagcccttcctatctgggccaggccggactacaaccctccactgttggaccgctggaaagcaccggattatgtaccaccaactgtccatggatgtgccttaccaccacggggcgctccaccggtgcctcctcctcggaggaaaagaacaatccagctggacggctccaatgtgtccgcggcgctagctgcgctagcggaaaaatcattcccgaccccaaaatcgcaggaagagaatagctcatcctctggggtcgacacacagtccagcactacctccaggatgcccccctctccaggaggggagtccgactcagagtcatgctcgtccatgcctcctctcgagggagagccgggcgatccggacttgagttgcgactcttggtccaccgttagtgacaacgaggagcagagcgtggtctgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 50 - DNA, 9642 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacacttcctaaacctcaaagaaaaaccaaaagaaacaccatccgtcgcccacaggacgttaagttcccgggtggcggacagatcgttggtggagtatacgtgttgccgcgcaggggcccacgattgggtgtgcgcgcgacgcgtaaaacttctgaacggtcacagcctcgcggacgacgacagcctatccccaaggcgcgtcggagcgaaggccggtcctgggctcagcccgggtacccttggcccctctatggtaatgagggctgcgggtgggcagggtggctcctgtccccgcgcggctcccgtccatcttggggcccaaacgacccccggcggaggtcccgcaatttgggtaaagtcatcgatacccttacgtgcggattcgccgacctcatggggtacatcccgctcgtcggcgctcccgtaggaggcgtcgcaagagccctcgcgcatggcgtgagggcccttgaagacgggataaattttgcaacagggaacttgcccggttgctccttttctatcttccttcttgctctgttctcctgcttagttcatcctgcagctagtcttgagtggcggaatacgtctggcctctatgtccttaccaacgactgttccaatagcagtattgtgtatgaggccgatgacgtcattctgcacacacccggctgtgtaccttgtgttcaggacgacaatacatccacgtgctggaccccagtgacacctacggtggcagtcaggtacgtcggagcaaccaccgcttcgatacgcagtcatgtggacctattagtgggcgcggccacgctgtgctctgcgctctatgtgggtgatatgtgtggggccgtctttctcgtgggacaagccttcacgttcagacctcgtcgccatcaaacggtccagacctgtaactgctcgctgtacccaggccatgtttcaggacatcgaatggcttgggatatgatgatgaattggtcccccgctgtgggtatggtggtggcgcacatcctgcgattgccccagaccttgtttgacatactggccggggcccattggggcatcttggcgggcctagcctattattctatgcagggcaactgggccaaggtcgctattgtcatgattatgttttcaggggtcgatgctgaaacatatgtcaccggtggcagtgtagctcatagtgccagagggttaactagcctttttagtatgggcgccaagcagaaactgcaattggtcaacaccaatggctcgtggcacatcaacagtactgccctgaactgcaatgagtccataaacaccgggttcatagctgggttgttttattaccataagttcaactctactggatgtcctcaaaggcttagcagctgcaagcccatcatttccttcaggcaggggtggggccccttgacagatgctaacatcaccggtccttctgatgatagaccgtattgctggcactacgcacctagaccttgtagtgttgtcccggcatcaagtgtctgcggccctgtgtactgcttcacaccatcgccagtggtcgtaggcactactgatatcaaaggcaagccgacctacaactggggtgagaatgagacagatgtgttcctgctggagtccctgcggcctcccagtggccggtggtttggatgcgcgtggatgaactccacggggttcctcaagacgtgtggagctcccccttgtaacatctatgggggtgagggggatcccgaaaatgagacagacctcttctgccccaccgactgcttcaggaaacatcctgaggccacatacagccggtgtggtgcggggccctggttgacacctcgctgcatggtcgactatccataccggctttggcattacccatgtacagtcaatttcacattgttcaaggtgaggatgtttgtgggcggatttgaacaccggtttaccgccgcttgtaactggaccaggggggagcgctgcaatatcgaggatcgtgatcgcagcgagcaacatccgctgctgcattcaacaactgagcttgctatactgccttgctctttcacgcccatgcctgcattgtcaacaggtctaatacacctccaccaaaatatcgtggatgtccaatacctttatggtgttggatctgacatggtgggatgggcgctgaaatgggagttcgtcatcctcgttttcctcctcctggcagacgcacgcgtgtgcgttgccctttggctgatgctgatggtatcacaagcagaagcagccttggagaaccttgtcacgctgaacgccgtcgctgctgctgggacacatggtattggttggtacctggtagccttttgcgcggcgtggtacgtgcggggtaaacttgtcccgctgacgagctacggcctgacgggtctttggtccctagcattgcttgtcctcttgctcccccaacgggcgtatgcttggtcgggtgaagacagcgctactctcggcgctggggtcttggccctcttcggcttctttaccttatcaccctggtacaagcattggatcggccgcctcatgtggtggaaccagtacactatatgtagatgcgaggccgcccttcaagtgtgggtcccccccttacttgcacgcgggagtagggacggtgtcatcctgctaacaagcttgctttatccatccttaatttttgacatcactaagctgctgatagcagtaataggcccattatacttaatacaggctgccatcactaccaccccctactttgtgcgcgcacatgtactggtccgcctttgcatgctcgtgcgctccgtgatggggggaaagtacttccagatggccatactgagcattggcagatggttcaacacctacctatatgaccacctagcgccaatgcaacattgggccgcagctggcctcaaagacctagcagtggccactgaacctgtaatatttagtcccatggaaattaaggtcatcacctggggcgcggacacagcggcttgcggagatattctttgcgggctgccggtctccgcgcgattaggccgtgaggtattgttgggacctgctgatgattatcgggaaatgggttggcgtctgttggctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagcaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgcagcggcgattggctgcgtgacatctgggactgggtttgctcggtgttgtccgacttcaagacgtggctctctgctaagattatgccagcactccctgggctgcccttcatctcctgtcaaaagggatacaagggcgtgtggcggggggatggtgtgatgtcgacacgctgtccttgcggggcatcaatcactggccacgtgaagaatgggtccatgcggcttgcggggccgcgtatgtgtgctaacatgtggcacggtactttccccatcaatgagtacaccaccggacccagcacaccttgcccatcacccaactacactcgcgcactatggcgcgtggctgccagcagctacgttgaggtgcgccgggtgggggacttccattatattacgggggctacagaagatgagctcaagtgtccgtgccaagtgccggctgctgagttctttactgaagtggatggggtgagactccaccgttacgcccctccatgtaagcccctgttgagagaagagatcactttctcggtagggttgcattcctacgcgataggatctcaactcccctgtgagccagaaccagatgtttctgtgttgacctcgatgttgagagacccttctcatatcaccgccgagacggcagcgcgccgccttgcgcgcgggtcccctccatcagaggcaagctcatccgccagccaactatcggctccgtcgttgaaggccacttgccagacgcataggcctcatccagacgctgagctggtggacgccaacttgttatggcggcaagagatgggcagcaacattacacgggtggagtctgaaacgaaggttgtgattcttgattcattcgaacctctgagagccgaagctgacgacgccgagctctcggtggctgcagagtgtttcaagaagcctcccaagtatcctccagcccttcctatctgggccaggccggactacaaccctccactgttggaccgctggaaagcaccggattatgtaccaccaactgtccatggatgtgccttaccaccacggggcgctccaccggtgcctcctcctcggaggaaaagaacaatccagctggacggctccaatgtgtccgcggcgctagctgcgctagcggaaaaatcattcccgaccccaaaatcgcaggaagagaatagctcatcctctggggtcgacacacagtccagcactacctccaggatgcccccctctccaggaggggagtccgactcagagtcatgctcgtccatgcctcctctcgagggagagccgggcgatccggacttgagttgcgactcttggtccaccgttagtgacaacgaggagcagagcgtggtccgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 51 - DNA, 9603 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacgaatcctaaacctcaaagaaaaaccaaacgtaacaccaaccgccgcccaatggacgttaagttcccgggtggtggccagatcgttggcggagtttacttgttgccgcgcaggggccccagattgggtgtgcgcgcgactcggaagacttcggagcggtcgcaacctcgtggaagacgccaacctatccccaaggcgcgtcgacccgagggaaggtcctgggcacaaccaggatatccatggcctctttacggtaatgagggttgtgggtgggcaggatggctcttgtccccccgtggctctcgaccgtcttggggcccaaatgatccccggcggaggtcccgcaatttgggtaaggtcatcgataccctaacctgcggcttcgccgacctcatgggatacatcccgctcgtaggcgcccccgtgggtggcgtcgccagggccctggcacatggtgtcagggctttggaggacgggatcaattatgcaacagggaatctccccggttgctccttttctatcttcctcttggcacttctttcgtgcctgactgtccccgcttcggccgttaactatcgcaatgtctcgggcatctaccatgtcaccaatgactgcccgaattcaagcatagtgtatgaggccgaccatcacatcttgcaccttccaggttgcgtgccctgcgtgagagaggggaatcagtcacgctgctgggtggcccttactcctaccgtcgcagcgccatacatcggcgcaccgcttgagtccttacggagtcatgtggatttgatggtgggggccgccactgtttgctcgggtctttacatcggggacctgtgtggcggcttgttcctagttggccagatgttttcattccgaccacggcgccactggaccacccaggattgcaattgttccatctacacagggcacattacaggccacagaatggcctgggacatgatgatgaactggagtccaacaaccaccttagttctcgcccaggtcatgaggatcccaaccactctggtagacttactctctggaggccactggggtgtcctcgtgggagtggcctatttcagcatgcaggccaattgggccaaagtcatcttggtcctattcctctttgcaggggttgatgccgagactcacgtgtctggggcagcagtcggccggagtaccgccggcttggctaacctcttttcttctgggtctaagcagaatttacagctcatcaacagcaatgggagctggcatataaataggactgcccttaactgcaatgacagcttaaacactgggttcttggctagcttgttctacacccacaagtttaacagctcagggtgttccgaacggctcgcgtgctgcaagagccttgacagctacggccaaggctggggcccactcggggtcgctaacatcagcggctcgtctgatgacaggccttattgctggcactacgcgcctcggccgtgcgggattgtgccagcatccagtgtgtgtggccccgtgtattgtttcactcccagccctgtcgtggtcggtactactgatcacgtcggggtccctacttacacctggggggagaatgagactgatgtcttccttttgaactcgaccagaccgccgcatggtgcgtggtttggatgcgtgtggatgaacagtaccgggttcaccaaaacctgtggcgcccctccatgcgaggttaacaccaataatgggacctggcactgccccaccgattgcttcaggaagcatccggagactacctacgccaagtgcggatcagggccttggatcacaccgcgctgcctgattgattacccgtaccggctgtggcatttcccgtgcaccgccaacttctccgtctttaacatcaggacatttgtcggcggtatagagcatcggatgcaagcggcatgcaactggaccaggggggaagtctgtggcttggagcacagggatcgcgtagagctatcacccctgctccttaccactacagcgtggcagatcctcccctgctctttcaccactttacctgccctctccaccggcttgatccacctccaccaaaatatcgtggacgtccagtacctctatggtgttgggtctgcagtggtatcttgggcccttaagtgggaatatgtggtgctcgcgttcctgcttctcgcggacgcgagagtctctgcctgcctatggatgatgtttatggtaagtcaagttgaggcggctctgtccaacctgattaacatcaatgctgcttcagccgctggtgcccaaggcttctggtacgccatcctcttcatctgcattgtctggcatgtcaagggccggttcccagctgctgctgcctacgcagcctgcgggctgtggcccctgtttctcctgcttctgatgctgcctgagagggcttatgcatacgaccaggaagtggcagggtcccttggcggcgccatcgttgtcatgctgaccattctgacactgtctccgcactacaagttatggctggctaggggattgtggtggatccaatattttatagctaggaccgaggctgtgctgcatgtctatattccatccttcaacgtgcgcgggcctcgcgactcagtgattgttcttgcagtcctggtctgtccacacctagtatttgacatcacaaaatatcttctggccatcttagggcccctccacatactccaggcctcgctcctacgcatcccttactttgtgagggcacaagcgctggttaagatctgcagcttgttgcgtggggtagtttatggcaagtacttccaaatggtcgtgcttaaagcaggggccctgactggtacttacatctatgaccaccttactcccatgtcagattgggccgctacgggcctccgcgatttggcggtggccctagagccagttgtgttcacgcccatggagaagaaagtcatcgtctggggcgctgacaccgctgcgtgcggagacatcataaggggattacctgtttcggccaggttgggcaatgaaatcttgctcggaccagccgatacagaaacatcaaaggggtggagactccttgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgcgccgaatcttggctatgggaggtatgggattgggtctgcaccgtgctgagtgacttcaagacgtggctaaaagccaagttgctgcccctcatgccaggcatccccttcctctcatgccagaggggctataagggagagtggcgcggagatggcgtgatgcataccacatgcccctgcggagcagatctggcaggtcacatcaagaacggctcgatgagaatcaccgggccgaaaacctgcagcaacacatggcatggtaccttccccatcaatgcttacaccacaggccctggtgtacccatcccggcgccgaactacaagttcgcgctttggagggtgtccgccgaggactacgtggaggttcgcagagtgggtgatttccattatgtcaccggggtaacacaagacaacatcaagtgcccctgccaagttccggccccagagttcttcacggaagtggacggcatcaggctacaccgccacgccccgaagtgcaaacccttgctgcgggacgaagtgtcgttctcagtaggactcaattcgttcgtagtgggatcacaactcccatgcgagccagagccggacgtggcagtgctaacatccatgctgacagacccatcacacataacggcggaatcggcgcgtcggagattggctcgagggtcacgaccctcgctagctagttcctcggcgagtcagctttccgccccgtctctcaaggccacgtgtaccgctccccatgactcccctggtactgatctcctcgaggctaacctcttgtgggggtctaccgctaccagggttgagacggacgagaaggtaataatactagactcttttgagtcatgtgtggctgagccaaatgatgacagggaagtctcggttgccgcggaaatcctgcgtccgaccaagaagttccctccagcactaccgatctgggcccggccggattacaatccacctcttaccgagacgtggaagcagcaggactacaagcctccgaccgtccacgggtgcgctctgcctcccggcaagcagccccccgttcctcctcccaggaggaaacggacggtacagctcactgagtccgttgtttctaccgctttggcagagctggccgcaaagacctttggccagtcagagccgagctcagaccgtgatacagaccttaccaccccaactgagaccacagactcgggccccatcgtcgtggatgatgcatccgatgacggatcttattcgtcaatgcctccactagagggggagcccggtgacccggacttgacatcagactcttggtccactgttagcggatcggaggacgtcgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 52 - DNA, 9603 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacgaatcctaaacctcaaagaaaaaccaaacgtaacaccaaccgccgcccaatggacgttaagttcccgggtggtggccagatcgttggcggagtttacttgttgccgcgcaggggccccagattgggtgtgcgcgcgactcggaagacttcggagcggtcgcaacctcgtggaagacgccaacctatccccaaggcgcgtcgacccgagggaaggtcctgggcacaaccaggatatccatggcctctttacggtaatgagggttgtgggtgggcaggatggctcttgtccccccgtggctctcgaccgtcttggggcccaaatgatccccggcggaggtcccgcaatttgggtaaggtcatcgataccctaacctgcggcttcgccgacctcatgggatacatcccgctcgtaggcgcccccgtgggtggcgtcgccagggccctggcacatggtgtcagggctttggaggacgggatcaattatgcaacagggaatctccccggttgctccttttctatcttcctcttggcacttctttcgtgcctgactgtccccgcttcggccgttaactatcgcaatgtctcgggcatctaccatgtcaccaatgactgcccgaattcaagcatagtgtatgaggccgaccatcacatcttgcaccttccaggttgcgtgccctgcgtgagagaggggaatcagtcacgctgctgggtggcccttactcctaccgtcgcagcgccatacatcggcgcaccgcttgagtccttacggagtcatgtggatttgatggtgggggccgccactgtttgctcgggtctttacatcggggacctgtgtggcggcttgttcctagttggccagatgttttcattccgaccacggcgccactggaccacccaggattgcaattgttccatctacacagggcacattacaggccacagaatggcctgggacatgatgatgaactggagtccaacaaccaccttagttctcgcccaggtcatgaggatcccaaccactctggtagacttactctctggaggccactggggtgtcctcgtgggagtggcctatttcagcatgcaggccaattgggccaaagtcatcttggtcctattcctctttgcaggggttgatgccgagactcacgtgtctggggcagcagtcggccggagtaccgccggcttggctaacctcttttcttctgggtctaagcagaatttacagctcatcaacagcaatgggagctggcatataaataggactgcccttaactgcaatgacagcttaaacactgggttcttggctagcttgttctacacccacaagtttaacagctcagggtgttccgaacggctcgcgtgctgcaagagccttgacagctacggccaaggctggggcccactcggggtcgctaacatcagcggctcgtctgatgacaggccttattgctggcactacgcgcctcggccgtgcgggattgtgccagcatccagtgtgtgtggccccgtgtattgtttcactcccagccctgtcgtggtcggtactactgatcacgtcggggtccctacttacacctggggggagaatgagactgatgtcttccttttgaactcgaccagaccgccgcatggtgcgtggtttggatgcgtgtggatgaacagtaccgggttcaccaaaacctgtggcgcccctccatgcgaggttaacaccaataatgggacctggcactgccccaccgattgcttcaggaagcatccggagactacctacgccaagtgcggatcagggccttggatcacaccgcgctgcctgattgattacccgtaccggctgtggcatttcccgtgcaccgccaacttctccgtctttaacatcaggacatttgtcggcggtatagagcatcggatgcaagcggcatgcaactggaccaggggggaagtctgtggcttggagcacagggatcgcgtagagctatcacccctgctccttaccactacagcgtggcagatcctcccctgctctttcaccactttacctgccctctccaccggcttgatccacctccaccaaaatatcgtggacgtccagtacctctatggtgttgggtctgcagtggtatcttgggcccttaagtgggaatatgtggtgctcgcgttcctgcttctcgcggacgcgagagtctctgcctgcctatggatgatgtttatggtaagtcaagttgaggcggctctgtccaacctgattaacatcaatgctgcttcagccgctggtgcccaaggcttctggtacgccatcctcttcatctgcattgtctggcatgtcaagggccggttcccagctgctgctgcctacgcagcctgcgggctgtggcccctgtttctcctgcttctgatgctgcctgagagggcttatgcatacgaccaggaagtggcagggtcccttggcggcgccatcgttgtcatgctggccattctgacactgtctccgcactacaagttatggctggctaggggattgtggtggatccaatattttatagctaggaccgaggctgtgctgcatgtctatattccatccttcaacgtgcgcgggcctcgcgactcagtgattgttcttgcagtcctggtctgtccacacctagtatttgacatcacaaaatatcttctggccatcttagggcccctccacatactccaggcctcgctcctacgcatcccttactttgtgagggcacaagcgctggttaagatctgcagcttgttgcgtggggtagtttatggcaagtacttccaaatggtcgtgcttaaagcaggggccctgactggtacttacatctatgaccaccttactcccatgtcagattgggccgctacgggcctccgcgatttggcggtggccctagagccagttgtgttctcgcccatggagaagaaagtcatcgtctggggcgctgacaccgctgcgtgcggagacatcataaggggattacctgtttcggccaggttgggcaatgaaatcttgctcggaccagccgatacagaaacatcaaaggggtggagactccttgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgcgccgaatcttggctatgggaggtatgggattgggtctgcaccgtgctgagtgacttcaagacgtggctaaaagccaagttgctgcccctcatgccaggcatccccttcctctcatgccagaggggctataagggagagtggcgcggagatggcgtgatgcataccacatgcccctgcggagcagatctggcaggtcacatcaagaacggctcgatgagaatcaccgggccgaaaacctgcagcaacacatggcatggtaccttccccatcaatgcttacaccacaggccctggtgtacccatcccggcgccgaactacaagttcgcgctttggagggtgtccgccgaggactacgtggaggttcgcagagtgggtgatttccattatgtcaccggggtaacacaagacaacatcaagtgcccctgccaagttccggccccagagttcttcacggaagtggacggcatcaggctacaccgccacgccccgaagtgcaaacccttgctgcgggacgaagtgtcgttctcagtaggactcaattcgttcgtagtgggatcacaactcccatgcgagccagagccggacgtggcagtgctaacatccatgctgacagacccatcacacataacggcggaatcggcgcgtcggagattggctcgagggtcacgaccctcgctagctagttcctcggcgagtcagctttccgccccgtctctcaaggccacgtgtaccgctccccatgactcccctggtactgatctcctcgaggctaacctcttgtgggggtctaccgctaccagggttgagacggacgagaaggtaataatactagactcttttgagtcatgtgtggctgagccaaatgatgacagggaagtctcggttgccgcggaaatcctgcgtccgaccaagaagttccctccagcactaccgatctgggcccggccggattacaatccacctcttaccgagacgtggaagcagcaggactacaagcctccgaccgtccacgggtgcgctctgcctcccggcaagcagccccccgttcctcctcccaggaggaaacggacggtacagctcactgagtccgttgtttctaccgctttggcagagctggccgcaaagacctttggccagtcagagccgagctcagaccgtgatacagaccttaccaccccaactgagaccacagactcgggccccatcgtcgtggatgatgcatccgatgacggatcttattcgtcaatgcctccactagagggggagcccggtgacccggacttgacatcagactcttggtccactgttagcggatcggaggacgtcgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 53 - DNA, 9621 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacgaatcctaaacctcaaagaaaaaccaaaagaaacaccaaccgccgcccacaggacgtcaagttcccgggcggtggtcagatcgttggtggagtttacttgttgccgcgcaggggccctaggttgggtgtgcgcgcaactcggaagacttcagaacggtcgcaaccccgtggacggcgtcagcctatccccaaggcgcgccagcccacgggccggtcctggggtcaacccgggtacccttggcccctttatgccaatgagggcctcgggtgggcagggtggttgctctccccccgaggctctcggcctaattggggccccaatgacccccggcggaaatcgcgcaacttgggtaaggtcatcgataccctgacgtgcggattcgccgacctcatggggtacatcccgctcgtaggcggccccgttgggggcgtcgcaagggctctcgcacacggtgtgagggtccttgaggacggggtaaactatgcaacagggaatttacccggttgctctttctctatctttatccttgcacttctttcatgcctgactgtcccgacctctgccgttccctaccgaaatgcctctggggtttatcatgtcaccaatgattgcccaaactcttctatcgtctatgaggctgaagacctgatcttacacgcacctggttgcgtgccctgtgttaggcagggtaatgtcagtaggtgctgggtccagatcacccccacactgtcagccccgagcctcggagcggtcacggctcctcttcggagggccgttgactacttagcggggggggctgccctttgctccgcgttatacgtcggagacgcgtgcggggcagtgtttttggtaggtcaaatgttcacctatagccctcgccggcataatgttgtgcaggactgcaactgttccatttacagtggccacatcaccggccaccggatggcatgggacatgatgatgaattggtcacctacaacagctttggtgatggcccagttgttacggattccccaggtggtcattgacatcattgccggggcccactggggggtcttgttcgccgccgcatactacgcgtcggcggctaactgggccaaggttgtgctggtcctgtttctgtttgcgggggtcgatgccagcacccgcactgtgggtggtagtgcggcccaaggcgcgcgcgggctcgcttcacttttcacccctgggccgcagcagaacttgcagctcataaataccaacgggagctggcacatcaacagaactgcccttaactgtaatgacagcctccagactgggtttgtagccggcctcctgtattatcacaagttcaactccactgggtgtccgcagcggatggctagctgtaggcccctcgccgcattcgaccagggctggggaactatcagctatgccgccgtgtcgggccccagtgatgacaagccctattgctggcactaccccccacgcccgtgcggaatagtgccagcgcgaggtgtctgcggtccggtctattgttttacacctagcccggtggtcgtcggcaccacagaccgcaaggggaatcccacttacagttggggcgaaaatgagactgacatctttctcttgaacaacacgaggccccctactggcaactggtttggctgcacctggatgaattccacagggtttgtcaagacttgcggggctccaccctgcaacttagggcctacaggcaacaatagccttaagtgtcctactgattgcttccgcaagcacccagacgccacctacaccaagtgtgggtcaggaccctggctcactccccggtgtctggtgcattacccttaccggttgtggcattacccgtgcaccctaaattacaccatcttcaaggtgcgcatgtacattgggggcctcgagcacaggctcgaggtggcatgcaactggacccgtggtgagcggtgtgatcttgaagacagggatagggccgagctgagcccgctcctacataccaccacgcagtgggccatattgccgtgctctttcacacccacacccgctcttagcactggtctcatacacttacatcaaaatatagtagacacccagtatctttacggtctgagctccagcatcgtctcgtgggccgttaagtgggagtacatagtgctggccttcttattacttgctgatgcccgtatttgtacttgcctatggatcatgctcctggtttgtcaggccgaagcggccctggagaacgtcattgtcctaaacgcggctgcggctgcggggactcatgggtttttctggggcctgctcgtcatctgcttcgcctggcacttcaagggcaggttggtccctggggccacctacctttgcttgggcatttggccattactcttactccttttcctcctgccccaaagggctctagccctggactcaagcgatggcgggactgtgggttgtcttgtgttaaccatccttacaatcttcacactcacccccgggtacaagaagatggtagtgttggtcatatggtggcttcagtatttcatagcccgggtagaggcctttatccatgtgtgggtgcccccgttgcaggttaggggtggtcgtgatgctattatcatgctcacatgccttttccatcctgccctggggtttgaggtcacgaaaatcctcctcgggatactaggtcctttgtacctgctgcagtactcgctcatcaagctgccttatttcatcagggcgcgcgccctgctgagggcgtgcctgctagcgaagcacttggcctgtggcaggtacgtgcaggcggccttgctccaccttggtaggctgaccggaacgtacatttatgaccaccttgcccccatgaaggattgggcagcgtccgggctgcgcgacttagcagtggccacggagcccatcatattctcccctatggagacgaaggtcatcacgtggggggctgacacggccgcatgtggggacatacttgccggccttcctgtatcagctaggcgaggccatgaaatcttcctggggccagccgatgacatcagagaggcgggctggcgacttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgcgatggcacatggctaagggccatttgggactgggtctgcacggcactgacagacttcaaagcctggctgcaggcaaaactcctcccacaactccccggagtgcccttcctctcgtgtcagagagggtacaagggcgtatggcgtggggatggagtaaattccaccaagtgtccgtgcggagcgacgatatctggccacgtgaaaaacggaaccatgaggatcgtcggcccgaagctgtgcagcaacacctggcacggaaccttccccatcaacgccacaacaacggggcccagtgtgcctgctccggcccccaactacaagtttgccttgtggagggtaggcgctgcggactacgccgaggtgcgccgcgtgggggactaccattacatcacgggggtgacacaggacaatctgaagtgtccctgtcaggtaccatctccagagttcttcacggagctggacggcgtgaggattcaccgctacgcgccaccctgcaaccccctcctaagggaggaggtctgcttctccgtggggctgcactcctttgtggtggggtcccaactaccctgtgagccagaacctgatgtgaccgtcctaacgtcaatgctgtcagaccctgctcacatcacggcagagacggccaagcgcaggctagatcgagggtctccgccctctctagctagctcctcggccagccaactctcggccccctcccttaaggctacttgcactacacaaggtcaccatccagacgcagacctcatagaggctaatctgctatggagacagtgcatgggaggtaacatcacgcgagtggaagccgagaacaaggtcgtgatccttgactcctttgagccgcttaaggcggatgacgacgacagagagatctctgtgtccgctgactgctttaggaggggaccggcgtttccccccgccctgccagtatgggcaaggccggggtatgacccacccctcctggagacttggaagcagcctgattatgaccccccccaggtgtcaggttgcccgctaccacctgcgggtctcccacctgtcccgcctccacgtaggaagaggaaaccggtggtgctatctgactccaacgtgtcccaagtcctggccgacttggcgcatgccaggttcaaggccgacacgcaatccattgaaggccaggattctgcggtgggcaccagtagccaacccgactcagggcctgaggagaagcgtgatgatgactcggacgcggcttcatattcttccatgcctccgctggagggcgagcctggggaccctgacctttcgtcagggtcgtggtcaactgtcagcgatgaggacagtgtggtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 54 - DNA, 9621 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacgaatcctaaacctcaaagaaaaaccaaaagaaacaccaaccgccgcccacaggacgtcaagttcccgggcggtggtcagatcgttggtggagtttacttgttgccgcgcaggggccctaggttgggtgtgcgcgcaactcggaagacttcagaacggtcgcaaccccgtggacggcgtcagcctatccccaaggcgcgccagcccacgggccggtcctggggtcaacccgggtacccttggcccctttatgccaatgagggcctcgggtgggcagggtggttgctctccccccgaggctctcggcctaattggggccccaatgacccccggcggaaatcgcgcaacttgggtaaggtcatcgataccctgacgtgcggattcgccgacctcatggggtacatcccgctcgtaggcggccccgttgggggcgtcgcaagggctctcgcacacggtgtgagggtccttgaggacggggtaaactatgcaacagggaatttacccggttgctctttctctatctttatccttgcacttctttcatgcctgactgtcccgacctctgccgttccctaccgaaatgcctctggggtttatcatgtcaccaatgattgcccaaactcttctatcgtctatgaggctgaagacctgatcttacacgcacctggttgcgtgccctgtgttaggcagggtaatgtcagtaggtgctgggtccagatcacccccacactgtcagccccgagcctcggagcggtcacggctcctcttcggagggccgttgactacttagcggggggggctgccctttgctccgcgttatacgtcggagacgcgtgcggggcagtgtttttggtaggtcaaatgttcacctatagccctcgccggcataatgttgtgcaggactgcaactgttccatttacagtggccacatcaccggccaccggatggcatgggacatgatgatgaattggtcacctacaacagctttggtgatggcccagttgttacggattccccaggtggtcattgacatcattgccggggcccactggggggtcttgttcgccgccgcatactacgcgtcggcggctaactgggccaaggttgtgctggtcctgtttctgtttgcgggggtcgatgccagcacccgcactgtgggtggtagtgcggcccaaggcgcgcgcgggctcgcttcacttttcacccctgggccgcagcagaacttgcagctcataaataccaacgggagctggcacatcaacagaactgcccttaactgtaatgacagcctccagactgggtttgtagccggcctcctgtattatcacaagttcaactccactgggtgtccgcagcggatggctagctgtaggcccctcgccgcattcgaccagggctggggaactatcagctatgccgccgtgtcgggccccagtgatgacaagccctattgctggcactaccccccacgcccgtgcggaatagtgccagcgcgaggtgtctgcggtccggtctattgttttacacctagcccggtggtcgtcggcaccacagaccgcaaggggaatcccacttacagttggggcgaaaatgagactgacatctttctcttgaacaacacgaggccccctactggcaactggtttggctgcacctggatgaattccacagggtttgtcaagacttgcggggctccaccctgcaacttagggcctacaggcaacaatagccttaagtgtcctactgattgcttccgcaagcacccagacgccacctacaccaagtgtgggtcaggaccctggctcactccccggtgtctggtgcattacccttaccggttgtggcattacccgtgcaccctaaattacaccatcttcaaggtgcgcatgtacattgggggcctcgagcacaggctcgaggtggcatgcaactggacccgtggtgagcggtgtgatcttgaagacagggatagggccgagctgagcccgctcctacataccaccacgcagtgggccatattgccgtgctctttcacacccacacccgctcttagcactggtctcatacacttacatcaaaatatagtagacacccagtatctttacggtctgagctccagcatcgtctcgtgggccgttaagtgggagtacatagtgctggccttcttattacttgctgatgcccgtatttgtacttgcctatggatcatgctcctggtttgtcaggccgaagcggccctggagaacgtcattgtcctaaacgcggctgcggctgcggggactcatgggtttttctggggcctgctcgtcatctgcttcgcctggcacttcaagggcaggttggtccctggggccacctacctttgcttgggcatttggccattactcttactccttttcctcctgccccaaagggctctagccctggactcaagcgatggcgggactgtgggttgtcttgtgttaaccatccttacaatcttcacactcacccccgggtacaagaagatggtagtgttggtcatatggtggcttcagtatttcatagcccgggtagaggcctttatccatgtgtgggtgcccccgttgcaggttaggggtggtcgtgatgctattatcatgctcacatgccttttccatcctgccctggggtttgaggtcacgaaaatcctcctcgggatactaggtcctttgtacctgctgcagtactcgctcatcaagctgccttatttcatcagggcgcgcgccctgctgagggcgtgcctgctagcgaagcacttggcctgtggcaggtacgtgcaggcggccttgctccaccttggtaggctgaccggaacgtacatttatgaccaccttgcccccatgaaggattgggcagcgtccgggctgcgcgacttagcagtggccacggagcccatcatattctcccctatggagacgaaggtcatcacgtggggggctgacacggccgcatgtggggacatacttgccggccttcctgtatcagctaggcgaggccatgaaatcttcctggggccagccgatgacatcagagaggggggctggcgacttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaggtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgcgatggcacatggctaagggccatttgggactgggtctgcacggcactgacagacttcaaagcctggctgcaggcaaaactcctcccacaactccccggagtgcccttcctctcgtgtcagagagggtacaagggcgtatggcgtggggatggagtaaattccaccaagtgtccgtgcggagcgacgatatctggccacgtgaaaaacggaaccatgaggatcgtcggcccgaagctgtgcagcaacacctggcacggaaccttccccatcaacgccacaacaacggggcccagtgtgcctgctccggcccccaactacaagtttgccttgtggagggtaggcgctgcggactacgccgaggtgcgccgcgtgggggactaccattacatcacgggggtgacacaggacaatctgaagtgtccctgtcaggtaccatctccagagttcttcacggagctggacggcgtgaggattcaccgctacgcgccaccctgcaaccccctcctaagggaggaggtctgcttctccgtggggctgcactcctttgtggtggggtcccaactaccctgtgagccagaacctgatgtgaccgtcctaacgtcaatgctgtcagaccctgctcacatcacggcagagacggccaagcgcaggctagatcgagggtctccgccctctctagctagctcctcggccagccaactctcggccccctcccttaaggctacttgcactacacaaggtcaccatccagacgcagacctcatagaggctaatctgctatggagacagtgcatgggaggtaacatcacgcgagtggaagccgagaacaaggtcgtgatccttgactcctttgagccgcttaaggcggatgacgacgacagagagatctctgtgtccgctgactgctttaggaggggaccggcgtttccccccgccctgccagtatgggcaaggccggggtatgacccacccctcctggagacttggaagcagcctgattatgaccccccccaggtgtcaggttgcccgctaccacctgcgggtctcccacctgtcccgcctccacgtaggaagaggaaaccggtggtgctatctgactccaacgtgtcccaagtcctggccgacttggcgcatgccaggttcaaggccgacacgcaatccattgaaggccaggattctgcggtgggcaccagtagccaacccgactcagggcctgaggagaagcgtgatgatgactcggacgcggcttcatattcttccatgcctccgctggagggcgagcctggggaccctgacctttcgtcagggtcgtggtcaactgtcagcgatgaggacagtgtggtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 55 - DNA, 9621 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacgaatcctaaacctcaaagaaaaaccaaaagaaacaccaaccgccgcccacaggacgtcaagttcccgggcggtggtcagatcgttggtggagtttacttgttgccgcgcaggggccctaggttgggtgtgcgcgcaactcggaagacttcagaacggtcgcaaccccgtggacggcgtcagcctatccccaaggcgcgccagcccacgggccggtcctggggtcaacccgggtacccttggcccctttatgccaatgagggcctcgggtgggcagggtggttgctctccccccgaggctctcggcctaattggggccccaatgacccccggcggaaatcgcgcaacttgggtaaggtcatcgataccctgacgtgcggattcgccgacctcatggggtacatcccgctcgtaggcggccccgttgggggcgtcgcaagggctctcgcacacggtgtgagggtccttgaggacggggtaaactatgcaacagggaatttacccggttgctctttctctatctttatccttgcacttctttcatgcctgactgtcccgacctctgccgttccctaccgaaatgcctctggggtttatcatgtcaccaatgattgcccaaactcttctatcgtctatgaggctgaagacctgatcttacacgcacctggttgcgtgccctgtgttaggcagggtaatgtcagtaggtgctgggtccagatcacccccacactgtcagccccgagcctcggagcggtcacggctcctcttcggagggccgttgactacttagcggggggggctgccctttgctccgcgttatacgtcggagacgcgtgcggggcagtgtttttggtaggtcaaatgttcacctatagccctcgccggcataatgttgtgcaggactgcaactgttccatttacagtggccacatcaccggccaccggatggcatgggacatgatgatgaattggtcacctacaacagctttggtgatggcccagttgttacggattccccaggtggtcattgacatcattgccggggcccactggggggtcttgttcgccgccgcatactacgcgtcggcggctaactgggccaaggttgtgctggtcctgtttctgtttgcgggggtcgatgccagcacccgcactgtgggtggtagtgcggcccaaggcgcgcgcgggctcgcttcacttttcacccctgggccgcagcagaacttgcagctcataaataccaacgggagctggcacatcaacagaactgcccttaactgtaatgacagcctccagactgggtttgtagccggcctcctgtattatcacaagttcaactccactgggtgtccgcagcggatggctagctgtaggcccctcgccgcattcgaccagggctggggaactatcagctatgccgccgtgtcgggccccagtgatgacaagccctattgctggcactaccccccacgcccgtgcggaatagtgccagcgcgaggtgtctgcggtccggtctattgttttacacctagcccggtggtcgtcggcaccacagaccgcaaggggaatcccacttacagttggggcgaaaatgagactgacatctttctcttgaacaacacgaggccccctactggcaactggtttggctgcacctggatgaattccacagggtttgtcaagacttgcggggctccaccctgcaacttagggcctacaggcaacaatagccttaagtgtcctactgattgcttccgcaagcacccagacgccacctacaccaagtgtgggtcaggaccctggctcactccccggtgtctggtgcattacccttaccggttgtggcattacccgtgcaccctaaattacaccatcttcaaggtgcgcatgtacattgggggcctcgagcacaggctcgaggtggcatgcaactggacccgtggtgagcggtgtgatcttgaagacagggatagggccgagctgagcccgctcctacataccaccacgcagtgggccatattgccgtgctctttcacacccacacccgctcttagcactggtctcatacacttacatcaaaatatagtagacacccagtatctttacggtctgagctccagcatcgtctcgtgggccgttaagtgggagtacatagtgctggccttcttattacttgctgatgcccgtatttgtacttgcctatggatcatgctcctggtttgtcaggccgaagcggccctggagaacgtcattgtcctaaacgcggctgcggctgcggggactcatgggtttttctggggcctgctcgtcatctgcttcgcctggcacttcaagggcaggttggtccctggggccacctacctttgcttgggcatttggccattactcttactccttttcctcctgccccaaagggctctagccctggactcaagcgatggcgggactgtgggttgtcttgtgttaaccatccttacaatcttcacactcacccccgggtacaagaagatggtagtgttggtcatatggtggcttcagtatttcatagcccgggtagaggcctttatccatgtgtgggtgcccccgttgcaggttaggggtggtcgtgatgctattatcatgctcacatgccttttccatcctgccctggggtttgaggtcacgaaaatcctcctcgggatactaggtcctttgtacctgctgcagtactcgctcatcaagctgccttatttcatcagggcgcgcgccctgctgagggcgtgcctgctagcgaagcacttggcctgtggcaggtacgtgcaggcggccttgctccaccttggtaggctgaccggaacgtacatttatgaccaccttgcccccatgaaggattgggcagcgtccgggctgcgcgacttagcagtggccacggagcccatcatattctcccctatggagacgaaggtcatcacgtggggggctgacacggccgcatgtggggacatacttgccggccttcctgtatcagctaggcgaggccatgaaatcttcctggggccagccgatgacatcagagaggggggctggcgacttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaggtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgcgatggcacatggctaggggccatttgggactgggtctgcacggcactgacagacttcaaagcctggctgcaggcaaaactcctcccacaactccccggagtgcccttcctctcgtgtcagagagggtacaagggcgtatggcgtggggatggagtaaattccaccaagtgtccgtgcggagcgacgatatctggccacgtgaaaaacggaaccatgaggatcgtcggcccgaagctgtgcagcaacacctggcacggaaccttccccatcaacgccacaacaacggggcccagtgtgcctgctccggcccccaactacaagtttgccttgtggagggtaggcgctgcggactacgccgaggtgcgccgcgtgggggactaccattacatcacgggggtgacacaggacaatctgaagtgtccctgtcaggtaccatctccagagttcttcacggagctggacggcgtgaggattcaccgctacgcgccaccctgcaaccccctcctaagggaggaggtctgcttctccgtggggctgcactcctttgtggtggggtcccaactaccctgtgagccagaacctgatgtgaccgtcctaacgtcaatgctgtcagaccctgctcacatcacggcagagacggccaagcgcaggctagatcgagggtctccgccctctctagctagctcctcggccagccaactctcggccccctcccttaaggctacttgcactacacaaggtcaccatccagacgcagacctcatagaggctaatctgctatggagacagtgcatgggaggtaacatcacgcgagtggaagccgagaacaaggtcgtgatccttgactcctttgagccgcttaaggcggatgacgacgacagagagatctctgtgtccgctgactgctttaggaggggaccggcgtttccccccgccctgccagtatgggcaaggccggggtatgacccacccctcctggagacttggaagcagcctgattatgaccccccccaggtgtcaggttgcccgctaccacctgcgggtctcccacctgtcccgcctccacgtaggaagaggaaaccggtggtgctatctgactccaacgtgtcccaagtcctggccgacttggcgcatgccaggttcaaggccgacacgcaatccattgaaggccaggattctgcggtgggcaccagtagccaacccgactcagggcctgaggagaagcgtgatgatgactcggacgcggcttcatattcttccatgcctccgctggagggcgagcctggggaccctgacctttcgtcagggtcgtggtcaactgtcagcgatgaggacagtgtggtgcgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 56 - DNA, 9639 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacacttccaaaaccccaaagaaaaaccaaaagaaacaccaaccgtcgcccaatggacgtcaagttcccgggtggcggtcagatcgttggcggagtttacttgttgccgcgcaggggcccccggttgggtgtgcgcgcgacgaggaagacttccgagcgatcccagcccagaggcaggcgccaacctataccaaaggcgcgccagccccagggcaggcactgggctcagcccggatatccttggcccctttatgggaacgagggctgtgggtgggcaggttggctcctgtccccccgcggctcccggccacactggggccccaacgacccccggcgtcgatcccggaatttgggtaaggtcatcgataccctaacgtgtgggttcgccgatctcatggggtacattcccgtcgtgggcgcgcctttgggcggcgtcgcggctgcactcgcacatggtgtgagggcaatcgaggacgggatcaattatgcaacagggaatcttcccggttgctctttctctatcttcctcttggcactactctcgtgcctcacaacgccagcgtcggctcttacctacggtaactccagtgggctataccatcttacaaatgattgccccaactccagcatcgtgctggaggcggatgccatgatcttgcatttgcctggatgcttgccttgtgtgagggtcaataacaaccagtccatctgttggcatgctgtgtcccccaccctagccataccaaatgcttccacacctgcaacgggattccgtaggcatgtggaccttcttgcgggcgccgcagtggtttgctcatccctgtacatcggggatctgtgcggctccctctttttggcagggcaactatttacctttcagccccgccgtcactggactgtgcaagactgcaactgctccatttatacaggccacgtcaccggccacaggatggcttgggacatgatgatgaattggtcacccacaaccactctggtcctatctagtatcttgagggtacctgagatctgtgcgagtgtgatatctggtggccattgggggatactactagccgttgcctactttggtatggctggcaactggctaaaagttctggctgtcctgttcttatttgcaggggttgaagcaaccaccaccatcggccatcaagtaggccgcactactggtggcttagccagtctcttctccatcggtcccaggcaaaatctacaactcatcaacaccactggcagctggcatataaacaggactgctctgaactgcaatgattccctccagacggggttcataacgtcactcttttatgccaagaacgtcaactcctcgggctgcccagagcggatggctgcgtgtaagcccctcgcggacttccggcaggggtggggccaaataacctacaaagtcaacatctcgggcccctccgacgaccgtccctactgttggcattacgctcccaggccatgtgacgtggtgtcggcccgcacggtgtgcggccccgtttactgcttcacgcccagccctgtcgtagtaggaaccactgacaagctgggcattcccacatacaactggggggagaatgagacggatgtgttcatgttggaaagccttcggcctcctactggaggatggtttgggtgcacgtggatgaactctacgggctttaccaagacctgtggtgccccgccatgtcagatagtcccgggagattacaatagctctgccaatgagcttttgtgccccaccgactgcttccgtaaacatccggaagctacatatcagcggtgtggatcgggaccctggatcacacctaggtgtctggtggattacccctacaggctgtggcactacccctgtactgtcaacttcaccttgcataaagtcaggatgttcgtgggaggcattgagcatcggtttgacgccgcatgtaactggaccagaggcgagcggtgtgatctacatgacagagacaggattgaaatgagcccgctgcttttctcaactacgcagcttgccatacttccctgttcattttccaccatgccggccttgtcaaccggcctcatccacctgcatcagaacatagtggacgtgcagtacctctacggagtctcctcgagcgttacctcgtgggtggtgaagtgggagtacattgttctggtgttcctggttctggcagatgctcggatttgtacatgtctctggttaatgctgctcataaccaacgttgaagcagcagtggaaaggcttgtcgtcctcaatgcggctagcgccgccggcaccgccggctggtggtgggcggtgctcttcctgtgctgtgcttggtacgtgaaaggccgccttgtgcctgcgtgtacctacatggcactgggaatgtggccgttgctcctgacaatcttggccctgcctcgccgagcatacgctatggacaatgagcaagcggcatccctcggagctgttggtctcttggtgctcaccatctttaccatcacccccatgtacaagaagctgttgacctgctccatttggtggaatcagtatttcctcgcccgagctgaggccatgatacacgagtgggtgcccgacctacgggttaggggcggtagggactccatcatcttacttacctgcttgttacatccacagctggggtttgaggtcaccaaaattctactagccatcctggcccctctatacatcctgcagtacagtttgctcaaggtgccttactttgtgcgcgcccacgtactcctgcgtgcttgcctgcttgttcgtaggctagcagggggtaagtacgtgcaggcgtgccttctgaggttgggcgcttggactggcacctttgtctatgaccatctcgcccctctctctgactgggctagcgacggactgcgcgatttggcagtcgcaatcgagccggtcattttctctcccatggagaagaaaatcattacctggggtgcggataccgccgcgtgtggtgacatcttgagtggcctcccggtgtcagcgaggttggggaatttggtgctactgggacccgcggacgatatgcagcgcgggggttggaagcttttggctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgcgctacctcatggttgcgcgacgtgtgggactgggtgtgtacagtgttatctgattttagagtatggctgaaagccaaactcctcccacgcctgccggggatccccttcctctcgtgccaaacgggatataggggagtctgggcaggggacggggtgtgccacaccacttgtacctgtggggccgtgatagctggacacgtcaaaaatggcaccatgaaaatcacagggcccaagacatgcagtaacacttggcacgggacttttccaatcaacgccaccactaccggccccagcacaccacgaccagcgccgaactatcagcgcgctctttggcgggtatctgccgaggactacgttgaagtacggaggttgggcgactgccactatgtggtaggggtcactgctgaagggctgaagtgcccttgccaggtgcctgcgcctgaattcttcactgaggtcgatggcgtgaggatacaccgttacgcgccaccttgtaagcccttgctcagggacgaagtgacattctctgtgggtctttcaagctatgccatagggtctcagctcccttgtgagccagagcctgacgtgaccgtagtcacctcaatgctcacagaccccacgcacatcaccgcagagacggcagcacggcggttgaagagggggtcccccccctccttagccagctcttcggccagccagctgtctgcaccgtccctcaaggctacttgcacaacatccaaagaccacccggacatggaactcattgaggccaacctcctttggaggcaggagatgggaggcaacatcactcgggtcgagtcggagaacaaagttgtaatacttgactcctttgagcctttaaccgctgagtatgacgagagggaaatctcagtatcagctgagtgccataggccacctaggcgcaaattccctccagctctcccaatatgggccaggcctgactacaatccacctcttatacaagcatggcaaatgcccgggtacgagcctccagtcgtgtctggatgcgccgtcgccccacctaagccggcaccaattcccccgccgaggcggaagaggctagtgcacttggatgagtccacggtctcgcacgccttggcacagcttgccgacaaggtatttgtggagagtagtagtgacccaggacctagttcagactcgggactatcaatagccagtcccgttccacctgccccaacaacaccagacgacgcctgctcagaagcagggtcctatagctcaatgccccctcttgagggggagcctggtgaccctgacctaagctcaggttcttggtccactgtgagcgatcaggacgacgtcgtgtgttgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 57 - DNA, 9639 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacacttccaaaaccccaaagaaaaaccaaaagaaacaccaaccgtcgcccaatggacgtcaagttcccgggtggcggtcagatcgttggcggagtttacttgttgccgcgcaggggcccccggttgggtgtgcgcgcgacgaggaagacttccgagcgatcccagcccagaggcaggcgccaacctataccaaaggcgcgccagccccagggcaggcactgggctcagcccggatatccttggcccctttatgggaacgagggctgtgggtgggcaggttggctcctgtccccccgcggctcccggccacactggggccccaacgacccccggcgtcgatcccggaatttgggtaaggtcatcgataccctaacgtgtgggttcgccgatctcatggggtacattcccgtcgtgggcgcgcctttgggcggcgtcgcggctgcactcgcacatggtgtgagggcaatcgaggacgggatcaattatgcaacagggaatcttcccggttgctctttctctatcttcctcttggcactactctcgtgcctcacaacgccagcgtcggctcttacctacggtaactccagtgggctataccatcttacaaatgattgccccaactccagcatcgtgctggaggcggatgccatgatcttgcatttgcctggatgcttgccttgtgtgagggtcaataacaaccagtccatctgttggcatgctgtgtcccccaccctagccataccaaatgcttccacacctgcaacgggattccgtaggcatgtggaccttcttgcgggcgccgcagtggtttgctcatccctgtacatcggggatctgtgcggctccctctttttggcagggcaactatttacctttcagccccgccgtcactggactgtgcaagactgcaactgctccatttatacaggccacgtcaccggccacaggatggcttgggacatgatgatgaattggtcacccacaaccactctggtcctatctagtatcttgagggtacctgagatctgtgcgagtgtgatatctggtggccattgggggatactactagccgttgcctactttggtatggctggcaactggctaaaagttctggctgtcctgttcttatttgcaggggttgaagcaaccaccaccatcggccatcaagtaggccgcactactggtggcttagccagtctcttctccatcggtcccaggcaaaatctacaactcatcaacaccactggcagctggcatataaacaggactgctctgaactgcaatgattccctccagacggggttcataacgtcactcttttatgccaagaacgtcaactcctcgggctgcccagagcggatggctgcgtgtaagcccctcgcggacttccggcaggggtggggccaaataacctacaaagtcaacatctcgggcccctccgacgaccgtccctactgttggcattacgctcccaggccatgtgacgtggtgtcggcccgcacggtgtgcggccccgtttactgcttcacgcccagccctgtcgtagtaggaaccactgacaagctgggcattcccacatacaactggggggagaatgagacggatgtgttcatgttggaaagccttcggcctcctactggaggatggtttgggtgcacgtggatgaactctacgggctttaccaagacctgtggtgccccgccatgtcagatagtcccgggagattacaatagctctgccaatgagcttttgtgccccaccgactgcttccgtaaacatccggaagctacatatcagcggtgtggatcgggaccctggatcacacctaggtgtctggtggattacccctacaggctgtggcactacccctgtactgtcaacttcaccttgcataaagtcaggatgttcgtgggaggcattgagcatcggtttgacgccgcatgtaactggaccagaggcgagcggtgtgatctacatgacagagacaggattgaaatgagcccgctgcttttctcaactacgcagcttgccatacttccctgttcattttccaccatgccggccttgtcaaccggcctcatccacctgcatcagaacatagtggacgtgcagtacctctacggagtctcctcgagcgttacctcgtgggtggtgaagtgggagtacattgttctggtgttcctggttctggcagatgctcggatttgtacatgtctctggttaatgctgctcataaccaacgttgaagcagcagtggaaaggcttgtcgtcctcaatgcggctagcgccgccggcaccgccggctggtggtgggcggtgctcttcctgtgctgtgcttggtacgtgaaaggccgccttgtgcctgcgtgtacctacatggcactgggaatgtggccgttgctcctgacaatcttggccctgcctcgccgagcatacgctatggacaatgagcaagcggcatccctcggagctgttggtctcttggtgctcaccatctttaccatcacccccatgtacaagaagctgttgacctgctccatttggtggaatcagtatttcctcgcccgagctgaggccatgatacacgagtgggtgcccgacctacgggttaggggcggtagggactccatcatcttacttacctgcttgttacatccacagctggggtttgaggtcaccaaaattctactagccatcctggcccctctatacatcctgcagtacagtttgctcaaggtgccttactttgtgcgcgcccacgtactcctgcgtgcttgcctgcttgttcgtaggctagcagggggtaagtacgtgcaggcgtgccttctgaggttgggcgcttggactggcacctttgtctatgaccatctcgcccctctctctgactgggctagcgacggactgcgcgatttggcagtcgcaatcgagccggtcattttctctcccatggagaagaaaatcattacctggggtgcggataccgccgcgtgtggtgacatcttgagtggcctcccggtgtcagcgaggttggggaatttggtgctactgggacccgcggacgatatgcagcgcgggggttggaagcttttggctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgcgctacctcatggttgcgcgacgtgtgggactgggtgtgtacagtgttatctgattttagagtatggctgaaagccaaactcctcccacgcctgccggggatccccttcctctcgtgccaaacgggatataggggagtctgggcaggggacggggtgtgccacaccacttgtacctgtggggccgtgatagctggacacgtcaaaaatggcaccatgaaaatcacagggcccaagacatgcagtaacacttggcacgggacttttccaatcaacgccaccactaccggccccagcacaccacgaccagcgccgaactatcagcgcgctctttggcgggtatctgccgaggactacgttgaagtacggaggttgggcgactgccactatgtggtaggggtcactgctgaagggctgaagtgcccttgccaggtgcctgcgcctgaattcttcactgaggtcgatggcgtgaggatacaccgttacgcgccaccttgtaagcccttgctcagggacgaagtgacattctctgtgggtctttcaagctatgccatagggtctcagctcccttgtgagccagagcctgacgtgaccgtagtcacctcaatgctcacagaccccacgcacatcaccgcagagacggcagcacggcggttgaagagggggtcccccccctccttagccagctcttcggccagccagctgtctgcaccgtccctcaaggctacttgcacaacatccaaagaccacccggacatggaactcattgaggccaacctcctttggaggcaggagatgggaggcaacatcactcgggtcgagtcggagaacaaagttgtaatacttgactcctttgagcctttaaccgctgagtatgacgagagggaaaactcagtatcagctgagtgccataggccacctaggcgcaaattccctccagctctcccaatatgggccaggcctgactacaatccacctcttatacaagcatggcaaatgcccgggtacgagcctccagtcgtgtctggatgcgccgtcgccccacctaagccggcaccaattcccccgccgaggcggaagaggctagtgcacttggatgagtccacggtctcgcacgccttggcacagcttgccgacaaggtatttgtggagagtagtagtgacccaggacctagttcagactcgggactatcaatagccagtcccgttccacctgccccaacaacaccagacgacgcctgctcagaagcagggtcctatagctcaatgccccctcttgagggggagcctggtgaccctgacctaagctcaggttcttggtccactgtgagcgatcaggacgacgtcgtgtgttgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 58 - DNA, 9618 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacgaatcctaaacctcaaagattaaccaaaagaaacaccgtccgtcgcccacagaacgttaagttcccgggtggcgggcagatcgttggcggagtctacttgttgccgcgcaggggccctagattgggtgtgcgcggcactaggaagagttcggagcgatcgcagcccaggggaagacgccaacgtatccccaaagctgcctcttcacagggtaaagcctggggcaagcccgggtacccttggcccctgtatggtaacgagggctgtggctgggcagggtggctcctgtccccccgcggctctcgacctacttggggccccactgacccccggcaccgctcgcgaaacctcggtaaggtgatcgacaccatgacctgcgggtttgccgacctcatggggtacatccctgtcctaggcgcccccctagggggcgttgccagggctctggcacatggtgttagagttctggaggacggggtcaactatgcaacagggaacttgcctggttgctccttttctatcttcttactagccctcctgtcatgtctaacagtcccggcatcggcttatgaagtccgcaactccagtggggtctatcatctcaccaatgactgccccaacgctagtatagtctatgaaacagacaacgccatcctacacgagcctgggtgcgtgccttgcgttcgcgagggtaatactagcaggtgttgggaaccagtggcccccactttggcggtccgctatcgcggagcgcttactgacgatttgcggacgcatattgacctagtggtggcgtcagctaccctgtgctccgccttgtacgtgggggacatttgtggagccatcttcattgccagccaagctgttctctggaagcccggggggggtcggatagtgcaagattgcaattgttcgatctacccgggccacgtcaccggccacaggatggcgtgggacatgatgcagaactgggcgccggccttgtcaatggttgccgcttacgctgtgagagtgcccggtgtcatcattaccactgtagcgggcggccactggggtgtgttatttggcctcgcttactttggtatggcgggaaactgggcaaaggtaatactcatcatgctactcatgtccggcgtcgacgcggaaaccatggccgtcggggctagggccgctcacaccactggcgcccttgtcagcctgctcaatccagggcccagtcagcgcctgcagctgatcaacaccaatgggtcatggcacatcaaccggaccgctttgaactgcaatgactctttgcagacagggttcatagcggccctcttctacacacataggttcaattctagtggctgtcccgagaggatggcttcttgtaaacctctcagtgactttgaccaggggtggggcccgctgtggtacaattcaacagaaagaccttcggaccagcgaccctattgctggcactacgcgccatcgccgtgtggtattgtgccggctaaggatgtttgcggtccggtctactgctttacaccaagcccggttgtggtgggcaccacggatcgccggggggtgcccacgtatacttggggtgaaaatgagtctgatgtcttcctgctcaacagcacaaggccgccgcaaggcagttggtttgggtgctcatggatgaacacaacggggttcacgaagacctgcggaggtcctccgtgcaagatacgtccccagggtgcccagagtaacacctctctcacttgtcccacagactgcttcaggaaacatccgcgtgccacatactccgcttgcggatctggtccgtggttgacacctagatgcatggtccattacccctatagactgtggcactacccgtgtacagtcaacttcaccatacacaaagtcaggttatacatagggggtgtagaacataggctcgatgcagcgtgcaattggacgcggggtgagcgatgcgacctggaggaccgagacagggtggacatgtcccccctgctccattccactacggagctcgcaatacttccgtgttcctttgtgccgcttccggccttatctacgggactgatccacctgcaccaaaacatcgttgacgcccagtacctttatggtctttctcccgctataataagctgggccatcagatgggagtgggtagtcctcgttttcctactcctggcggacgcgcggatctgcgcctgcctttggatgatgatgcttatggcccaggctgaagccgctctggagaacttgatccacctcaacgcggccagccttgcgggaacccatggtatctggtggctccttttagtcttttgtgcctcttggcatctacgaggcagggttgtccctctggtgacgtatgggatatgcgggatgtggcccttcttcctcatgttgctgagcctccccccacgagcgtatgctctggacagggaagtgagcgcagcgttgggaacgggcatgctcgccatcatcctattagttaccttgggaccgcactacaagagacttctagcccttattctctggtgggtcacatatttccttacaaggtgtgaagcagcactccaaacgtgggtccctcctctcaaccctcgggggggcagggacggtttcatcctgtgtgtgccgctgtgctatccaggccttgtctttgacatcacaaaatggttgctggtcatgatgtgccctctctacctcctccagttgtgtttggtgaggactccatactttgtgagggcccaggccctcatcagagtgtgttctctcttcaaaacgctagctgggggacggtacgtgcaggccgcgctgctcactattggccgctggaccggcacttatatttataaccatctcgcccccctggaaacatgggccgccggcggcctacgggatttggccgttgcagtcgagcccgtgatattctcccccatggagaagaagatcatagtttggggggcggagaccactgcttgtggcgacattctttgtggcctgcctgtctcagctcggctcggcagggaagtcctgctagggcccgcggatgactacaggtccatgggatggcaactcctggctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgcgccgggagctggctccgggaggtgtgggactgggtttgcatggtcctatccgactttgcatcttggttgaaggccaaggtacttcccagccttccagggatcccattcctatcctgtcagaaagggtataaaggtgagtggcggaacgatggcatcatgaacaccaagtgcccgtgtggggccctgatagcagggcacgtcaagaacggatcgatgcgcatcgtgggccccaagacctgccgaaacacctggtggggaaccttccctattaattcccataccacgggaccaagttctcctgtaccctcccactgttatcaaagggccttgtggagggtatctgcgacggagtacgtcgagatccttcgtcacaatgaccagcattacgtggtgggagtgacggcggaggacctcaagtgcccgtgtcaggttccttcccccgaattcttcagctttgtggacggggtgcggatacacagattcgcccctgaacccaagcccatgatccgggaagaagccgctttcgtggtgggtctgcactcatatgtggtggggtctcagctcccttgtgaaccggagccggacgtccaaactgtctcgcagctcctaaccgacccctcacacatcaccgcagaaaccgcggctagaaggctcaggagaggttcccccccatccaacgccagttcttctgctagtcaactctcagctccatctctaaaagccacccacacaactctgccacaacatcctgacgcagaactgatagaggccaacctcatgtgggaacataaggttggtgccatcagaaggatggagacagacaccaaagtcatcatacttgactcctttgattcagcttcttccgtcgaggatgacatggaaccgtccaccgccgcggagtgtctgcgtacgcgtaaggtcttcccaccggccatgcccatatgggcgaggccagactacaatcctcctgttgtggagaattggaaggaccccgagtacgcacctccccaggtgtctgggtgcgctctaccacctgcgcagacccctcctgttccaccacccaggcggaagcgggcggttatccaactcacagagtccgcggtttccacggcactggcggaactcgctgagaggtccttcccaaaggaggaggcaccccccagcgactccgccattagtctggattcaccggcggcaaatgaccctccatctgattgtgaccaaggcagtgagatctctttctcatccatgccacccctagagggggagccgggtgatccagacttgtctgatggctcttggtcaacagtcagcaccagatctgacgtgatttgctgttccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 59 - DNA, 9624 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggttcctggctaagggacatctgggactggatatgcgaggtgctgagcgactttaagacctggctgaaagccaagctcatgccacaactgcctgggattccctttgtgtcctgccagcgcgggtataggggggtctggcgaggagacggcattatgcacactcgctgccactgtggagctgagatcactggacatgtcaaaaacgggacgatgaggatcgtcggtcctaggacctgcaggaacatgtggagtgggacgttccccattaacgcccacaccacgggcccctgtactccccttcctgcgccgaactataagttcgcgctgtggagggtgtctgcagaggaatacgtggagataaggcgggtgggggacttccactacgtatcgggtatgactactgacaatcttaaatgcccgtgccagatcccatcgcccgaatttttcacagaattggacggggtgcgcctacacaggtttgcgcccccttgcaagcccttgctgcgggaggaggtatcattcagagtaggactccacgagtacccggtggggtcgcaattaccttgcgagcccgaaccggacgtagccgtgttgacgtccatgctcactgatccctcccatataacagcagaggcggccgggagaaggttggcgagagggtcacccccttctatggccagctcctcggctagccagctgtccgctccatctctcaaggcaacttgcaccgccaaccatgactcccctgacgccgagctcatagaggctaacctcctgtggaggcaggagatgggcggcaacatcaccagggttgagtcagagaacaaagtggtgattctggactccttcgatccgcttgtggcagaggaggatgagcgggaggtctccgtacctgcagaaattctgcggaagtctcggagattcgcccgggccctgcccgtctgggcgcggccggactacaaccccccgctagtagagacgtggaaaaagcctgactacgaaccacctgtggtccatggctgcccgctaccacctccacggtcccctcctgtgcctccgcctcggaaaaagcgtacggtggtcctcaccgaatcaaccctatctactgccttggccgagcttgccaccaaaagttttggcagctcctcaacttccggcattacgggcgacaatacgacaacatcctctgagcccgccccttctggctgcccccccgactccgacgttgagtcctattcttccatgccccccctggagggggagcctggggatccggatctcagcgacgggtcatggtcgacggtcagtagtggggccgacacggaagatgtcgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 60 - DNA, 9621 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcacggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgagctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggctcgtggctaagggatgtttgggattggatatgcacggtgttgactgacttcaagacctggctccagtccaaactcctgccgcggttaccgggagtccctttcctgtcatgccaacgcgggtacaagggagtctggcggggggacggcatcatgcaaaccacctgcccatgcggagcacagatcgccggacatgtcaaaaacggttccatgaggatcgtagggcctagaacctgcagcaacacgtggcacggaacgttccccatcaacgcacacaccacgggaccttgcacaccctccccggcgcccaactattccagggcgctatggcgggtggctgctgaggagtacgtggaggttacgcgtgtgggggatttccactacgtgacgggcatgaccactgacaacgtaaagtgcccatgccaggttccggcccccgaattcttcacggaggtggatggagtgcggttgcacaggtacgctccggcgtgcaaacctcttctacgggaggacgtcacgttccaggtcgggctcaaccaatacttggtcgggtcgcagctcccatgcgagcccgaaccggacgtaacagtgcttacttccatgctcaccgatccctcccacattacagcagagacggctaagcgtaggctggctagagggtctcccccctctttagccagctcatcagctagccagttgtctgcgccttctttgaaggcgacatgcactacccaccatgactccccggacgctgacctcatcgaggccaacctcttgtggcggcaggagatgggcggaaacatcactcgcgtggagtcagagaataaggtagtaattctggactctttcgaaccgcttcacgcggagggggatgagagggagatatccgtcgcggcggagatcctgcgaaaatccaggaagttcccctcagcgttgcccatatgggcacgcccggactacaatcctccactgctagagtcctggaaggacccggactacgtccctccggtggtacacggatgcccattgccacctaccaaggctcctccaataccacctccacggagaaagaggacggttgtcctgacagaatccaatgtgtcttctgccttggcggagctcgccactaagaccttcggtagctccggatcgtcggccgttgatagcggcacggcgaccgcccttcctgacctggcctccgacgacggtgacaaaggatccgacgttgagtcgtactcctccatgcccccccttgaaggggagccgggggaccccgatctcagcgacgggtcttggtctaccgtgagtgaggaggctagtgaggatgtcgtctgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 61 - DNA, 9678 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgccacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacctatgacgtggacatggtcgatgccaacctgctcatggagggcggtgtggctcagacagagcctgagtccagggtgcccgttctggactttctcgagccaatggccgaggaagagagcgaccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 62 - DNA, 9636 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgcagcggcggttggctgcgtgacatctgggactgggtttgctcggtgttgtccgacttcaagacgtggctctctgctaagattatgccagcactccctgggctgcccttcatctcctgtcaaaagggatacaagggcgtgtggcggggggatggtgtgatgtcgacacgctgtccttgcggggcatcaatcactggccacgtgaagaatgggtccatgcggcttgcggggccgcgtatgtgtgctaacatgtggcacggtactttccccatcaatgagcacaccaccggacccagcacaccttgcccatcacccaactacactcgcgcactatggcgcgtggctgccagcagctacgttgaggtgcgccgggtgggggacttccattatattacgggggctacagaagatgagctcaagtgtccgtgccaagtgccggctgctgagttctttactgaagtggatggggtgagactccaccgttacgcccctccatgtaagcccctgttgagagaagagatcactttctcggtagggttgcattcctacgcgataggatctcaactcccctgtgagccagaaccagatgtttctgtgttgacctcgatgttgagagacccttctcatatcaccgccgagacggcagcgcgccgccttgcgcgcgggtcccctccatcagaggcaagctcatccgccagccaactatcggctccgtcgttgaaggccacttgccagacgcataggcctcatccagacgctgagctggtggacgccaacttgttatggcggcaagagatgggcagcaacattacacgggtggagtctgaaacgaaggttgtgattcttgattcattcgaacctctgagagccgaagctgacgacgccgagctctcggtggctgcagagtgtttcaagaagcctcccaagtatcctccagcccttcctatctgggccaggccggactacaaccctccactgttggaccgctggaaagcaccggattatgtaccaccaactgtccatggatgtgccttaccaccacggggcgctccaccggtgcctcctcctcggaggaaaagaacaatccagctggacggctccaatgtgtccgcggcgctagctgcgctagcggaaaaatcattcccgaccccaaaatcgcaggaagagaatagctcatcctctggggtcgacacacagtccagcactacctccaggatgcccccctctccaggaggggagtccgactcagagtcatgctcgtccatgcctcctctcgagggagagccgggcgatccggacttgagttgcgactcttggtccaccgttagtgacaacgaggagcagagcgtggtctgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 63 - DNA, 9615 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatcttttccgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagcacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgcgccgaatcttggctatgggaggtatgggattgggtctgcaccgtgctgagtgacttcaagacgtggctaaaagccaagttgctgcccctcatgccaggcatccccttcctctcatgccagaggggctataagggagagtggcgcggagatggcgtgatgcataccacatgcccctgcggagcagatctggcaggtcacatcaagaacggctcgatgagaatcaccgggccgaaaacctgcagcaacacatggcatggtaccttccccatcaatgctcacaccacaggccctggtgtacccatcccggcgccgaactacaagttcgcgctttggagggtgtccgccgaggactacgtggaggttcgcagagtgggtgatttccattatgtcaccggggtaacacaagacaacatcaagtgcccctgccaagttccggccccagagttcttcacggaagtggacggcatcaggctacaccgccacgccccgaagtgcaaacccttgctgcgggacgaagtgtcgttctcagtaggactcaattcgttcgtagtgggatcacaactcccatgcgagccagagccggacgtggcagtgctaacatccatgctgacagacccatcacacataacggcggaatcggcgcgtcggagattggctcgagggtcacgaccctcgctagctagttcctcggcgagtcagctttccgccccgtctctcaaggccacgtgtaccgctccccatgactcccctggtactgatctcctcgaggctaacctcttgtgggggtctaccgctaccagggttgagacggacgagaaggtaataatactagactcttttgagtcatgtgtggctgagccaaatgatgacaggggagtctcggttgccgcggaaatcctgcgtccgaccaagaagttccctccagcactaccgatctgggcccggccggattacaatccacctcttaccgagacgtggaagcagcaggactacaagcctccgaccgtccacgggtgcgctctgcctcccggcaagcagccccccgttcctcctcccaggaggaaacggacggtacagctcactgagtccgttgtttctaccgctttggcagagctggccgcaaagacctttggccagtcagagccgagctcagaccgtgatacagaccttaccaccccaactgagaccacagactcgggccccatcgtcgtggatgatgcatccgatgacggatcttattcgtcaatgcctccactagagggggagcccggtgacccggacttgacatcagactcttggtccactgttagcggatcggaggacgtcgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 64 - DNA, 9630 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgcgatggcacatggctaggggccatttgggactgggtctgcacggcactgacagacttcaaagcctggctgcaggcaaaactcctcccacaactccccggagtgcccttcctctcgtgtcagagagggtacaagggcgtatggcgtggggatggagtaaattccaccaagtgtccgtgcggagcgacgatatctggccacgtgaaaaacggaaccatgaggatcgtcggcccgaagctgtgcagcaacacctggcacggaaccttccccatcaacgcccacacaacggggcccagtgtgcctgctccggcccccaactacaagtttgccttgtggagggtaggcgctgcggactacgccgaggtgcgccgcgtgggggactaccattacatcacgggggtgacacaggacaatctgaagtgtccctgtcaggtaccatctccagagttcttcacggagctggacggcgtgaggattcaccgctacgcgccaccctgcaaccccctcctaagggaggaggtctgcttctccgtggggctgcactcctttgtggtggggtcccaactaccctgtgagccagaacctgatgtgaccgtcctaacgtcaatgctgtcagaccctgctcacatcacggcagagacggccaagcgcaggctagatcgagggtctccgccctctctagctagctcctcggccagccaactctcggccccctcccttaaggctacttgcactacacaaggtcaccatccagacgcagacctcatagaggctaatctgctatggagacagtgcatgggaggtaacatcacgcgagtggaagccgagaacaaggtcgtgatccttgactcctttgagccgcttaaggcggatgacgacgacagagagatctctgtgtccgctgactgctttaggaggggaccggcgtttccccccgccctgccagtatgggcaaggccggggtatgacccacccctcctggagacttggaagcagcctgattatgaccccccccaggtgtcaggttgcccgctaccacctgcgggtctcccacctgtcccgcctccacgtaggaagaggaaaccggtggtgctatctgactccaacgtgtcccaagtcctggccgacttggcgcatgccaggttcaaggccgacacgcaatccattgaaggccaggattctgcggtgggcaccagtagccaacccgactcagggcctgaggagaagcgtgatgatgactcggacgcggcttcatattcttccatgcctccgctggagggcgagcctggggaccctgacctttcgtcagggtcgtggtcaactgtcagcgatgaggacggtgtggtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 65 - DNA, 9633 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgcgctacctcatggttgcgcgacgtgtgggactgggtgtgtacagtgttatctgattttagagtatggctgaaagccaaactcctcccacgcctgccggggatccccttcctctcgtgccaaacgggatataggggagtctgggcaggggacggggtgtgccacaccacttgtacctgtggggccgtgatagctggacacgtcaaaaatggcaccatgaaaatcacagggcccaagacatgcagtaacacttggcacgggacttttccaatcaacgcccacactaccggccccagcacaccacgaccagcgccgaactatcagcgcgctctttggcgggtatctgccgaggactacgttgaagtacggaggttgggcgactgccactatgtggtaggggtcactgctgaagggctgaagtgcccttgccaggtgcctgcgcctgaattcttcactgaggtcgatggcgtgaggatacaccgttacgcgccaccttgtaagcccttgctcagggacgaagtgacattctctgtgggtctttcaagctatgccatagggtctcagctcccttgtgagccagagcctgacgtgaccgtagtcacctcaatgctcacagaccccacgcacatcaccgcagagacggcagcacggcggttgaagagggggtcccccccctccttagccagctcttcggccagccagctgtctgcaccgtccctcaaggctacttgcacaacatccaaagaccacccggacatggaactcattgaggccaacctcctttggaggcaggagatgggaggcaacatcactcgggtcgagtcggagaacaaagttgtaatacttgactcctttgagcctttaaccgctgagtatgacgagagggaaaactcagtatcagctgagtgccataggccacctaggcgcaaattccctccagctctcccaatatgggccaggcctgactacaatccacctcttatacaagcatggcaaatgcccgggtacgagcctccagtcgtgtctggatgcgccgtcgccccacctaagccggcaccaattcccccgccgaggcggaagaggctagtgcacttggatgagtccacggtctcgcacgccttggcacagcttgccgacaaggtatttgtggagagtagtagtgacccaggacctagttcagactcgggactatcaatagccagtcccgttccacctgccccaacaacaccagacgacgcctgctcagaagcagggtcctatagctcaatgccccctcttgagggggagcctggtgaccctgacctaagctcaggttcttggtccactgtgagcgatcaggacgacgtcgtgtgttgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 66 - DNA, 9492 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggttcctggctaagggacatctgggactggatatgcgaggtgctgagcgactttaagacctggctgaaagccaagctcatgccacaactgcctgggattccctttgtgtcctgccagcgcgggtataggggggtctggcgaggagacggcattatgcacactcgctgccactgtggagctgagatcactggacatgtcaaaaacgggacgatgaggatcgtcggtcctaggacctgcaggaacatgtggagtgggacgttccccattaacgcctacaccacgggcccctgtactccccttcctgcgccgaactataagttcgcgctgtggagggtgtctgcagaggaatacgtggagataaggcgggtgggggacttccactacgtatcgggtatgactactgacaatcttaaatgcccgtgccagatcccatcgcccgaatttttcacagaattggacggggtgcgcctacacaggtttgcgcccccttgcaagcccttgctgcgggaggaggtatcattcagagtaggactccacgagtacccggtggggtcgcaattaccttgcgagcccgaaccggacgtagccgtgttgacgtccatgctcactgatccctcccatataacagcagaggcggccgggagaaggttggcgagagggtcacccccttctatggccagctcctcggctagccagctgtccgctccatctctcaaggcaacttgcaccgccaaccatgactcccgggaggtctccgtacctgcagaaattctgcggaagtctcggagattcgcccgggccctgcccgtctgggcgcggccggactacaaccccccgctagtagagacgtggaaaaagcctgactacgaaccacctgtggtccatggctgcccgctaccacctccacggtcccctcctgtgcctccgcctcggaaaaagcgtacggtggtcctcaccgaatcaaccctatctactgccttggccgagcttgccaccaaaagttttggcagctcctcaacttccggcattacgggcgacaatacgacaacatcctctgagcccgccccttctggctgcccccccgactccgacgttgagtcctattcttccatgccccccctggagggggagcctggggatccggatctcagcgacgggtcatggtcgacggtcagtagtggggccgacacggaagatgtcgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 67 - DNA, 9492 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggttcctggctgagggacatctgggactggatatgcgaggtgctgagcgactttaagacctggctgaaagccaagctcatgccgcaactgcctgggattccctttgtgtcctgccagcgtgggtataagggggtctggcgaggggacggcatcatgcacactcgctgccactgtggagctgagataactggacatgtcaaaaacgggacgatgaggatcgttggtcctaagacttgcaggaacatgtggagtgggactttccccattaacgcctacaccacgggcccctgtactccccttcctgcgccgaactatacgttcgcgctgtggagggtgtctgcagaggaatacgtggagataaggcaggtgggggacttccactacgtgacgggtatgactactgacaaccttaaatgcccgtgccaggtcccatcgcccgaatttttcacagaattggacggggtgcgcctacataggtttgcgcccccttgcaagcccctgctgcgggaggaggtgtcattcagagtgggactccacgagtacccggtggggtcgcaattaccttgcgagcccgaaccggacgtggccgtgttgacgtccatgctcactgatccctcccatataacagcagaggcggccgggagaaggttggcgaggggatcacccccctctatggccagctcctcggctagccaactgtccgctccatctctcagggcaacttgcactaccaaccatgactcccgggaggtctccgtgcccgcagagatactgcggaagtctcggaaattcaccccagccctacccatttgggcgcggccggactataaccccccgctggtggagccgtggaaaaagcctgactacgaaccacctgtggtccatggctgcccgcttccacctccacagtcccctcctgtgcctccacctcggaagaagcggacggtgatcctcaccgaatcaaccctacctactgccttggccgagcttgccaccaaaagttttggcagctcctcaacttccggcattacgggcgacgacacgacaacatcccctgagcccgcctcctctagctgccctcccgactccgacgctgagtcctattcttccatgccccctctggagggggagcctggggatccggatctcagcgacgggtcatggtcgacggtcagtagtgaggccgacaaggaggatgtcgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 68 - DNA, 9558 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 69 - DNA, 9579 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggttcctggctaagggacatctgggactggatatgcgaggtgctgagcgactttaagacctggctgaaagccaagctcatgccacaactgcctgggattccctttgtgtcctgccagcgcgggtataggggggtctggcgaggagacggcattatgcacactcgctgccactgtggagctgagatcactggacatgtcaaaaacgggacgatgaggatcgtcggtcctaggacctgcaggaacatgtggagtgggacgttccccattaacgcctacaccacgggcccctgtactccccttcctgcgccgaactataagttcgcgctgtggagggtgtctgcagaggaatacgtggagataaggcgggtgggggacttccactacgtatcgggtatgactactgacaatcttaaatgcccgtgccagatcccatcgcccgaatttttcacagaattggacggggtgcgcctacacaggtttgcgcccccttgcaagcccttgctgcgggaggaggtatcattcagagtaggactccacgagtacccggtggggtcgcaattaccttgcgagcccgaaccggacgtagccgtgttgacgtccatgctcactgatccctcccatataacagcagaggcggccgggagaaggttggcgagagggtcacccccttctatggccagctcctcggctagccagctgtccgctccatctctcaaggcaacttgcaccgccaaccatgactcccctgacgccgagctcatagaggctaacctcctgtggaggcaggagatgggcggcaacatcaccagggttgagtcagagaacaaagtggtgattctggactccttcgatccgcttgtggcagaggaggatgagcgggaggtctccgtacctgcagaaattctgcggaagtctcggagattcgcccgggccctgcccgtctgggcgcggccggactacaaccccccgctagtagagacgtggaaaaagcctgactacgaaccacctgtggtccatggctgcccgctaccacctccacggtcccctcctgtgcctccgcctcggaaaaagcgtacggtggtcctcaccgaatcaaccctatctactgccttggccgagcttgccaccaaaagttttggcagctcctcaacttccggcattacgggcgacaatacgacaacatcctctgagcccgccccttctggctgcccccccgactccgacgttgagtcctatagcgacgggtcatggtcgacggtcagtagtggggccgacacggaagatgtcgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 70 - DNA, 9579 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggttcctggctgagggacatctgggactggatatgcgaggtgctgagcgactttaagacctggctgaaagccaagctcatgccgcaactgcctgggattccctttgtgtcctgccagcgtgggtataagggggtctggcgaggggacggcatcatgcacactcgctgccactgtggagctgagataactggacatgtcaaaaacgggacgatgaggatcgttggtcctaagacttgcaggaacatgtggagtgggactttccccattaacgcctacaccacgggcccctgtactccccttcctgcgccgaactatacgttcgcgctgtggagggtgtctgcagaggaatacgtggagataaggcaggtgggggacttccactacgtgacgggtatgactactgacaaccttaaatgcccgtgccaggtcccatcgcccgaatttttcacagaattggacggggtgcgcctacataggtttgcgcccccttgcaagcccctgctgcgggaggaggtgtcattcagagtgggactccacgagtacccggtggggtcgcaattaccttgcgagcccgaaccggacgtggccgtgttgacgtccatgctcactgatccctcccatataacagcagaggcggccgggagaaggttggcgaggggatcacccccctctatggccagctcctcggctagccaactgtccgctccatctctcagggcaacttgcactaccaaccatgactcccctgatgctgagctcatagaggccaacctcctatggaggcaggagatgggcggcaacatcaccagggttgagtcagagaacaaagtggtgattctggactccttcgatccgcttgtggcagaggaggatgagcgggaggtctccgtgcccgcagagatactgcggaagtctcggaaattcaccccagccctacccatttgggcgcggccggactataaccccccgctggtggagccgtggaaaaagcctgactacgaaccacctgtggtccatggctgcccgcttccacctccacagtcccctcctgtgcctccacctcggaagaagcggacggtgatcctcaccgaatcaaccctacctactgccttggccgagcttgccaccaaaagttttggcagctcctcaacttccggcattacgggcgacgacacgacaacatcccctgagcccgcctcctctagctgccctcccgactccgacgctgagtcctatagcgacgggtcatggtcgacggtcagtagtgaggccgacaaggaggatgtcgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 71 - DNA, 9576 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcacggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgagctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggctcgtggctaagggatgtttgggattggatatgcacggtgttgactgacttcaagacctggctccagtccaaactcctgccgcggttaccgggagtccctttcctgtcatgccaacgcgggtacaagggagtctggcggggggacggcatcatgcaaaccacctgcccatgcggagcacagatcgccggacatgtcaaaaacggttccatgaggatcgtagggcctagaacctgcagcaacacgtggcacggaacgttccccatcaacgcatacaccacgggaccttgcacaccctccccggcgcccaactattccagggcgctatggcgggtggctgctgaggagtacgtggaggttacgcgtgtgggggatttccactacgtgacgggcatgaccactgacaacgtaaagtgcccatgccaggttccggcccccgaattcttcacggaggtggatggagtgcggttgcacaggtacgctccggcgtgcaaacctcttctacgggaggacgtcacgttccaggtcgggctcaaccaatacttggtcgggtcgcagctcccatgcgagcccgaaccggacgtaacagtgcttacttccatgctcaccgatccctcccacattacagcagagacggctaagcgtaggctggctagagggtctcccccctctttagccagctcatcagctagccagttgtctgcgccttctttgaaggcgacatgcactacccaccatgactccccggacgctgacctcatcgaggccaacctcttgtggcggcaggagatgggcggaaacatcactcgcgtggagtcagagaataaggtagtaattctggactctttcgaaccgcttcacgcggagggggatgagagggagatatccgtcgcggcggagatcctgcgaaaatccaggaagttcccctcagcgttgcccatatgggcacgcccggactacaatcctccactgctagagtcctggaaggacccggactacgtccctccggtggtacacggatgcccattgccacctaccaaggctcctccaataccacctccacggagaaagaggacggttgtcctgacagaatccaatgtgtcttctgccttggcggagctcgccactaagaccttcggtagctccggatcgtcggccgttgatagcggcacggcgaccgcccttcctgacctggcctccgacgacggtgacaaaggatccgacgttgagtcgtacagcgacgggtcttggtctaccgtgagtgaggaggctagtgaggatgtcgtctgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 72 - DNA, 9633 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacctatgacgtggacatggtcgatgccaacctgctcatggagggcggtgtggctcagacagagcctgagtccagggtgcccgttctggactttctcgagccaatggccgaggaagagagcgaccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgccgagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 73 - DNA, 9633 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatcttttccgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgcggcggctcgtggctccgcgatgtgtgggactgggtttgcaccatcctaacagactttaaaaattggctgacctccaaattattcccaaagatgcccggcctcccctttgtctcctgtcaaaaggggtacaagggcgtgtgggccggcactggcatcatgaccacacggtgtccttgcggcgccaatatctctggcaatgtccgcttgggctccatgagaatcacggggcctaagacctgcatgaatatctggcaggggacctttcctatcaattgttacacggagggccagtgcgtgccgaaacccgcgccaaactttaaggtcgccatctggagggtggcggcctcagagtacgcggaggtgacgcagcacgggtcataccactacataacaggactcaccactgataacttgaaagtcccctgccaactaccctctcccgagttcttttcctgggtggacggagtgcagatccataggtttgcccccacaccgaagccgtttttccgggatgaggtctcgttctgcgttgggcttaattcatttgtcgtcgggtcccagcttccttgcgaccctgaacccgacacagacgtattgatgtccatgctaacagatccatctcatatcacggcggagactgcagcgcggcgtttagcgcgggggtcacccccatccgaggcaagctcctcggcgagccagctatcggcaccatcgctgcgagccacctgcaccacccacggcaaagcctatgatgtggacatggtggatgctaacctgttcatggggggcgatgtgactcggatagagtctgggtccaaagtggtcgttctggactctctcgacccaatggtcgaagaaaggagcgaccttgagccttcgataccatcagaatacatgctccccaagaagaggttcccaccagctttaccggcctgggcacggcctgattacaacccaccgcttgtggaatcgtggaaaaggccagattaccaaccggccactgttgcgggctgtgctctccctcctcctaggaaaaccccgacgcctcccccaaggaggcgccggacagtgggcctaagtgaggactccataggagatgcccttcaacagctggccattaagtcctttggccagccccccccaagcggcgattcaggcctttccacgggggcgggcgctgccgattccggcagtcagacgcctcctgatgagttggccctttcggagacaggttccatcgagcctgagcaggtagagccccaaccccccccccaggggggggtggcagctcccggctcggactcggggtcctggtctacttgctccgaggaggacgactccgtcgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 74 - DNA, 9591 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgcagcggcggttggctgcgtgacatctgggactgggtttgctcggtgttgtccgacttcaagacgtggctctctgctaagattatgccagcactccctgggctgcccttcatctcctgtcaaaagggatacaagggcgtgtggcggggggatggtgtgatgtcgacacgctgtccttgcggggcatcaatcactggccacgtgaagaatgggtccatgcggcttgcggggccgcgtatgtgtgctaacatgtggcacggtactttccccatcaatgagtacaccaccggacccagcacaccttgcccatcacccaactacactcgcgcactatggcgcgtggctgccagcagctacgttgaggtgcgccgggtgggggacttccattatattacgggggctacagaagatgagctcaagtgtccgtgccaagtgccggctgctgagttctttactgaagtggatggggtgagactccaccgttacgcccctccatgtaagcccctgttgagagaagagatcactttctcggtagggttgcattcctacgcgataggatctcaactcccctgtgagccagaaccagatgtttctgtgttgacctcgatgttgagagacccttctcatatcaccgccgagacggcagcgcgccgccttgcgcgcgggtcccctccatcagaggcaagctcatccgccagccaactatcggctccgtcgttgaaggccacttgccagacgcataggcctcatccagacgctgagctggtggacgccaacttgttatggcggcaagagatgggcagcaacattacacgggtggagtctgaaacgaaggttgtgattcttgattcattcgaacctctgagagccgaagctgacgacgccgagctctcggtggctgcagagtgtttcaagaagcctcccaagtatcctccagcccttcctatctgggccaggccggactacaaccctccactgttggaccgctggaaagcaccggattatgtaccaccaactgtccatggatgtgccttaccaccacggggcgctccaccggtgcctcctcctcggaggaaaagaacaatccagctggacggctccaatgtgtccgcggcgctagctgcgctagcggaaaaatcattcccgaccccaaaatcgcaggaagagaatagctcatcctctggggtcgacacacagtccagcactacctccaggatgcccccctctccaggaggggagtccgactcagagtcatgcagttgcgactcttggtccaccgttagtgacaacgaggagcagagcgtggtctgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 75 - DNA, 9570 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatcttttccgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagcacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgcgccgaatcttggctatgggaggtatgggattgggtctgcaccgtgctgagtgacttcaagacgtggctaaaagccaagttgctgcccctcatgccaggcatccccttcctctcatgccagaggggctataagggagagtggcgcggagatggcgtgatgcataccacatgcccctgcggagcagatctggcaggtcacatcaagaacggctcgatgagaatcaccgggccgaaaacctgcagcaacacatggcatggtaccttccccatcaatgcttacaccacaggccctggtgtacccatcccggcgccgaactacaagttcgcgctttggagggtgtccgccgaggactacgtggaggttcgcagagtgggtgatttccattatgtcaccggggtaacacaagacaacatcaagtgcccctgccaagttccggccccagagttcttcacggaagtggacggcatcaggctacaccgccacgccccgaagtgcaaacccttgctgcgggacgaagtgtcgttctcagtaggactcaattcgttcgtagtgggatcacaactcccatgcgagccagagccggacgtggcagtgctaacatccatgctgacagacccatcacacataacggcggaatcggcgcgtcggagattggctcgagggtcacgaccctcgctagctagttcctcggcgagtcagctttccgccccgtctctcaaggccacgtgtaccgctccccatgactcccctggtactgatctcctcgaggctaacctcttgtgggggtctaccgctaccagggttgagacggacgagaaggtaataatactagactcttttgagtcatgtgtggctgagccaaatgatgacaggggagtctcggttgccgcggaaatcctgcgtccgaccaagaagttccctccagcactaccgatctgggcccggccggattacaatccacctcttaccgagacgtggaagcagcaggactacaagcctccgaccgtccacgggtgcgctctgcctcccggcaagcagccccccgttcctcctcccaggaggaaacggacggtacagctcactgagtccgttgtttctaccgctttggcagagctggccgcaaagacctttggccagtcagagccgagctcagaccgtgatacagaccttaccaccccaactgagaccacagactcgggccccatcgtcgtggatgatgcatccgatgacggatcttatacatcagactcttggtccactgttagcggatcggaggacgtcgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 76 - DNA, 9585 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgcgatggcacatggctaggggccatttgggactgggtctgcacggcactgacagacttcaaagcctggctgcaggcaaaactcctcccacaactccccggagtgcccttcctctcgtgtcagagagggtacaagggcgtatggcgtggggatggagtaaattccaccaagtgtccgtgcggagcgacgatatctggccacgtgaaaaacggaaccatgaggatcgtcggcccgaagctgtgcagcaacacctggcacggaaccttccccatcaacgccacaacaacggggcccagtgtgcctgctccggcccccaactacaagtttgccttgtggagggtaggcgctgcggactacgccgaggtgcgccgcgtgggggactaccattacatcacgggggtgacacaggacaatctgaagtgtccctgtcaggtaccatctccagagttcttcacggagctggacggcgtgaggattcaccgctacgcgccaccctgcaaccccctcctaagggaggaggtctgcttctccgtggggctgcactcctttgtggtggggtcccaactaccctgtgagccagaacctgatgtgaccgtcctaacgtcaatgctgtcagaccctgctcacatcacggcagagacggccaagcgcaggctagatcgagggtctccgccctctctagctagctcctcggccagccaactctcggccccctcccttaaggctacttgcactacacaaggtcaccatccagacgcagacctcatagaggctaatctgctatggagacagtgcatgggaggtaacatcacgcgagtggaagccgagaacaaggtcgtgatccttgactcctttgagccgcttaaggcggatgacgacgacagagagatctctgtgtccgctgactgctttaggaggggaccggcgtttccccccgccctgccagtatgggcaaggccggggtatgacccacccctcctggagacttggaagcagcctgattatgaccccccccaggtgtcaggttgcccgctaccacctgcgggtctcccacctgtcccgcctccacgtaggaagaggaaaccggtggtgctatctgactccaacgtgtcccaagtcctggccgacttggcgcatgccaggttcaaggccgacacgcaatccattgaaggccaggattctgcggtgggcaccagtagccaacccgactcagggcctgaggagaagcgtgatgatgactcggacgcggcttcatattcgtcagggtcgtggtcaactgtcagcgatgaggacggtgtggtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 77 - DNA, 9588 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgcgctacctcatggttgcgcgacgtgtgggactgggtgtgtacagtgttatctgattttagagtatggctgaaagccaaactcctcccacgcctgccggggatccccttcctctcgtgccaaacgggatataggggagtctgggcaggggacggggtgtgccacaccacttgtacctgtggggccgtgatagctggacacgtcaaaaatggcaccatgaaaatcacagggcccaagacatgcagtaacacttggcacgggacttttccaatcaacgccaccactaccggccccagcacaccacgaccagcgccgaactatcagcgcgctctttggcgggtatctgccgaggactacgttgaagtacggaggttgggcgactgccactatgtggtaggggtcactgctgaagggctgaagtgcccttgccaggtgcctgcgcctgaattcttcactgaggtcgatggcgtgaggatacaccgttacgcgccaccttgtaagcccttgctcagggacgaagtgacattctctgtgggtctttcaagctatgccatagggtctcagctcccttgtgagccagagcctgacgtgaccgtagtcacctcaatgctcacagaccccacgcacatcaccgcagagacggcagcacggcggttgaagagggggtcccccccctccttagccagctcttcggccagccagctgtctgcaccgtccctcaaggctacttgcacaacatccaaagaccacccggacatggaactcattgaggccaacctcctttggaggcaggagatgggaggcaacatcactcgggtcgagtcggagaacaaagttgtaatacttgactcctttgagcctttaaccgctgagtatgacgagagggaaaactcagtatcagctgagtgccataggccacctaggcgcaaattccctccagctctcccaatatgggccaggcctgactacaatccacctcttatacaagcatggcaaatgcccgggtacgagcctccagtcgtgtctggatgcgccgtcgccccacctaagccggcaccaattcccccgccgaggcggaagaggctagtgcacttggatgagtccacggtctcgcacgccttggcacagcttgccgacaaggtatttgtggagagtagtagtgacccaggacctagttcagactcgggactatcaatagccagtcccgttccacctgccccaacaacaccagacgacgcctgctcagaagcagggtcctatagctcaggttcttggtccactgtgagcgatcaggacgacgtcgtgtgttgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 78 - DNA, 9573 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgcgccgggagctggctccgggaggtgtgggactgggtttgcatggtcctatccgactttgcatcttggttgaaggccaaggtacttcccagccttccagggatcccattcctatcctgtcagaaagggtataaaggtgagtggcggaacgatggcatcatgaacaccaagtgcccgtgtggggccctgatagcagggcacgtcaagaacggatcgatgcgcatcgtgggccccaagacctgccgaaacacctggtggggaaccttccctattaattcccataccacgggaccaagttctcctgtaccctcccactgttatcaaagggccttgtggagggtatctgcgacggagtacgtcgagatccttcgtcacaatgaccagcattacgtggtgggagtgacggcggaggacctcaagtgcccgtgtcaggttccttcccccgaattcttcagctttgtggacggggtgcggatacacagattcgcccctgaacccaagcccatgatccgggaagaagccgctttcgtggtgggtctgcactcatatgtggtggggtctcagctcccttgtgaaccggagccggacgtccaaactgtctcgcagctcctaaccgacccctcacacatcaccgcagaaaccgcggctagaaggctcaggagaggttcccccccatccaacgccagttcttctgctagtcaactctcagctccatctctaaaagccacccacacaactctgccacaacatcctgacgcagaactgatagaggccaacctcatgtgggaacataaggttggtgccatcagaaggatggagacagacaccaaagtcatcatacttgactcctttgattcagcttcttccgtcgaggatgacatggaaccgtccaccgccgcggagtgtctgcgtacgcgtaaggtcttcccaccggccatgcccatatgggcgaggccagactacaatcctcctgttgtggagaattggaaggaccccgagtacgcacctccccaggtgtctgggtgcgctctaccacctgcgcagacccctcctgttccaccacccaggcggaagcgggcggttatccaactcacagagtccgcggtttccacggcactggcggaactcgctgagaggtccttcccaaaggaggaggcaccccccagcgactccgccattagtctggattcaccggcggcaaatgaccctccatctgattgtgaccaaggcagtgagatctctttctctgatggctcttggtcaacagtcagcaccagatctgacgtgatttgctgttccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 79 - DNA, 12387 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggatgacgatgacaaggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacctatgacgtggacatggtcgatgccaacctgctcatggagggcggtgtggctcagacagagcctgagtccagggtgcccgttctggactttctcgagccaatggccgaggaagagagcgaccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgtctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgggggggggggggtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcagcacgttgtaaaacgacggccagtgaattctaatacgactcactatag

SEQ ID NO: 80 - DNA, 12372 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacctatgacgtggacatggtcgatgccaacctgctcatggagggcggtgtggctcagacagagcctgagtccagggtgcccgttctggactttctcgagccaatggccgaggatgatgacgacaaggagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgtctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgggggggggggggtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcagcacgttgtaaaacgacggccagtgaattctaatacgactcactatag

SEQ ID NO: 81 - DNA, 12387 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacctatgacgtggacatggtcgatgccaacctgctcatggagggcggtgtggctcagacagagcctgagtccagggtgcccgttctggactttctcgagccaatggccgaggaagagagcgaccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccctcgagggggagcctggagatccggacctggagtctgatcaggtagagcttcaacctcccccccagggggggggggtagctcccggttcgggctcggatgacgatgacaaggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgtctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgggggggggggggtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcagcacgttgtaaaacgacggccagtgaattctaatacgactcactatag

SEQ ID NO: 82 - protein, 3015 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDIWDWICEVLSDFKTWLKAKLMPQLPGIPFVSCQRGYRGVWRGDGIMHTRCHCGAEITGHVKNGTMRIVGPRTCRNMWSGTFPINAYTTGPCTPLPAPNYKFALWRVSAEEYVEIRRVGDFHYVSGMTTDNLKCPCQIPSPEFFTELDGVRLHRFAPPCKPLLREEVSFRVGLHEYPVGSQLPCEPEPDVAVLTSMLTDPSHITAEAAGRRLARGSPPSMASSSASQLSAPSLKATCTANHDSPDAELIEANLLWRQEMGGNITRVESENKVVILDSFDPLVAEEDEREVSVPAEILRKSRRFARALPVWARPDYNPPLVETWKKPDYEPPVVHGCPLPPPRSPPVPPPRKKRTVVLTESTLSTALAELATKSFGSSSTSGITGDNTTTSSEPAPSGCPPDSDVESYSSMPPLEGEPGDPDLSDGSWSTVSSGADTEDVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 83 - protein, 3015 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFSVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDIWDWICEVLSDFKTWLKAKLMPQLPGIPFVSCQRGYRGVWRGDGIMHTRCHCGAEITGHVKNGTMRIVGPRTCRNMWSGTFPINAYTTGPCTPLPAPNYKFALWRVSAEEYVEIRRVGDFHYVSGMTTDNLKCPCQIPSPEFFTELDGVRLHRFAPPCKPLLREEVSFRVGLHEYPVGSQLPCEPEPDVAVLTSMLTDPSHITAEAAGRRLARGSPPSMASSSASQLSAPSLKATCTANHDSPDAELIEANLLWRQEMGGNITRVESENKVVILDSFDPLVAEEDEREVSVPAEILRKSRRFARALPVWARPDYNPPLVETWKKPDYEPPVVHGCPLPPPRSPPVPPPRKKRTVVLTESTLSTALAELATKSFGSSSTSGITGDNTTTSSEPAPSGCPPDSDVESYSSMPPLEGEPGDPDLSDGSWSTVSSGADTEDVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 84 - protein, 3015 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDIWDWICEVLSDFKTWLKAKLMPQLPGIPFVSCQRGYKGVWRGDGIMHTRCHCGAEITGHVKNGTMRIVGPKTCRNMWSGTFPINAYTTGPCTPLPAPNYTFALWRVSAEEYVEIRQVGDFHYVTGMTTDNLKCPCQVPSPEFFTELDGVRLHRFAPPCKPLLREEVSFRVGLHEYPVGSQLPCEPEPDVAVLTSMLTDPSHITAEAAGRRLARGSPPSMASSSASQLSAPSLRATCTTNHDSPDAELIEANLLWRQEMGGNITRVESENKVVILDSFDPLVAEEDEREVSVPAEILRKSRKFTPALPIWARPDYNPPLVEPWKKPDYEPPVVHGCPLPPPQSPPVPPPRKKRTVILTESTLPTALAELATKSFGSSSTSGITGDDTTTSPEPASSSCPPDSDAESYSSMPPLEGEPGDPDLSDGSWSTVSSEADKEDVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 85 - protein, 3015 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFSVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDIWDWICEVLSDFKTWLKAKLMPQLPGIPFVSCQRGYKGVWRGDGIMHTRCHCGAEITGHVKNGTMRIVGPKTCRNMWSGTFPINAYTTGPCTPLPAPNYTFALWRVSAEEYVEIRQVGDFHYVTGMTTDNLKCPCQVPSPEFFTELDGVRLHRFAPPCKPLLREEVSFRVGLHEYPVGSQLPCEPEPDVAVLTSMLTDPSHITAEAAGRRLARGSPPSMASSSASQLSAPSLRATCTTNHDSPDAELIEANLLWRQEMGGNITRVESENKVVILDSFDPLVAEEDEREVSVPAEILRKSRKFTPALPIWARPDYNPPLVEPWKKPDYEPPVVHGCPLPPPQSPPVPPPRKKRTVILTESTLPTALAELATKSFGSSSTSGITGDDTTTSPEPASSSCPPDSDAESYSSMPPLEGEPGDPDLSDGSWSTVSSEADKEDVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 86 - protein, 3014 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWICTVLTDFKTWLQSKLLPRLPGVPFLSCQRGYKGVWRGDGIMQTTCPCGAQIAGHVKNGSMRIVGPRTCSNTWHGTFPINAYTTGPCTPSPAPNYSRALWRVAAEEYVEVTRVGDFHYVTGMTTDNVKCPCQVPAPEFFTEVDGVRLHRYAPACKPLLREDVTFQVGLNQYLVGSQLPCEPEPDVTVLTSMLTDPSHITAETAKRRLARGSPPSLASSSASQLSAPSLKATCTTHHDSPDADLIEANLLWRQEMGGNITRVESENKVVILDSFEPLHAEGDEREISVAAEILRKSRKFPSALPIWARPDYNPPLLESWKDPDYVPPVVHGCPLPPTKAPPIPPPRRKRTVVLTESNVSSALAELATKTFGSSGSSAVDSGTATALPDLASDDGDKGSDVESYSSMPPLEGEPGDPDLSDGSWSTVSEEASEDVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 87 - protein, 3014 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFSVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWICTVLTDFKTWLQSKLLPRLPGVPFLSCQRGYKGVWRGDGIMQTTCPCGAQIAGHVKNGSMRIVGPRTCSNTWHGTFPINAYTTGPCTPSPAPNYSRALWRVAAEEYVEVTRVGDFHYVTGMTTDNVKCPCQVPAPEFFTEVDGVRLHRYAPACKPLLREDVTFQVGLNQYLVGSQLPCEPEPDVTVLTSMLTDPSHITAETAKRRLARGSPPSLASSSASQLSAPSLKATCTTHHDSPDADLIEANLLWRQEMGGNITRVESENKVVILDSFEPLHAEGDEREISVAAEILRKSRKFPSALPIWARPDYNPPLLESWKDPDYVPPVVHGCPLPPTKAPPIPPPRRKRTVVLTESNVSSALAELATKTFGSSGSSAVDSGTATALPDLASDDGDKGSDVESYSSMPPLEGEPGDPDLSDGSWSTVSEEASEDVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 88 - protein, 3014 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVHGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWICTVLTDFKTWLQSKLLPRLPGVPFLSCQRGYKGVWRGDGIMQTTCPCGAQIAGHVKNGSMRIVGPRTCSNTWHGTFPINAYTTGPCTPSPAPNYSRALWRVAAEEYVEVTRVGDFHYVTGMTTDNVKCPCQVPAPEFFTEVDGVRLHRYAPACKPLLREDVTFQVGLNQYLVGSQLPCEPEPDVTVLTSMLTDPSHITAETAKRRLARGSPPSLASSSASQLSAPSLKATCTTHHDSPDADLIEANLLWRQEMGGNITRVESENKVVILDSFEPLHAEGDEREISVAAEILRKSRKFPSALPIWARPDYNPPLLESWKDPDYVPPVVHGCPLPPTKAPPIPPPRRKRTVVLTESNVSSALAELATKTFGSSGSSAVDSGTATALPDLASDDGDKGSDVESYSSMPPLEGEPGDPDLSDGSWSTVSEEASEDVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 89 - protein, 3014 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVSSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWICTVLTDFKTWLQSKLLPRLPGVPFLSCQRGYKGVWRGDGIMQTTCPCGAQIAGHVKNGSMRIVGPRTCSNTWHGTFPINAYTTGPCTPSPAPNYSRALWRVAAEEYVEVTRVGDFHYVTGMTTDNVKCPCQVPAPEFFTEVDGVRLHRYAPACKPLLREDVTFQVGLNQYLVGSQLPCEPEPDVTVLTSMLTDPSHITAETAKRRLARGSPPSLASSSASQLSAPSLKATCTTHHDSPDADLIEANLLWRQEMGGNITRVESENKVVILDSFEPLHAEGDEREISVAAEILRKSRKFPSALPIWARPDYNPPLLESWKDPDYVPPVVHGCPLPPTKAPPIPPPRRKRTVVLTESNVSSALAELATKTFGSSGSSAVDSGTATALPDLASDDGDKGSDVESYSSMPPLEGEPGDPDLSDGSWSTVSEEASEDVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 90 - protein, 3014 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVHGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVSSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWICTVLTDFKTWLQSKLLPRLPGVPFLSCQRGYKGVWRGDGIMQTTCPCGAQIAGHVKNGSMRIVGPRTCSNTWHGTFPINAYTTGPCTPSPAPNYSRALWRVAAEEYVEVTRVGDFHYVTGMTTDNVKCPCQVPAPEFFTEVDGVRLHRYAPACKPLLREDVTFQVGLNQYLVGSQLPCEPEPDVTVLTSMLTDPSHITAETAKRRLARGSPPSLASSSASQLSAPSLKATCTTHHDSPDADLIEANLLWRQEMGGNITRVESENKVVILDSFEPLHAEGDEREISVAAEILRKSRKFPSALPIWARPDYNPPLLESWKDPDYVPPVVHGCPLPPTKAPPIPPPRRKRTVVLTESNVSSALAELATKTFGSSGSSAVDSGTATALPDLASDDGDKGSDVESYSSMPPLEGEPGDPDLSDGSWSTVSEEASEDVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 91 - protein, 3014 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVHGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVSSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWICTVLTDFKTWLQSKLLPRLPGVPFLSCQRGYKGVWRGDGIMQTTCPCGAQIAGHVKNGSMRIVGPRTCSNTWHGTFPINAYTTGPCTPSPAPNYSRALWRVAAEEYVEVTRVGDFHYVTGMTTDNVKCPCQVPAPEFFTEVDGVRLHRYAPACKPLLREDVTFQVGLNQYLVGSQLPCEPEPDVTVLTSMLTDPSHITAETAKRRLARGSPPSLASSSASQLSALSLKAACTGRHDSPDVDLIEANLLWRQEMGGNITRVESENKVVILDSFEPLHAEGDEREISVAAEILRKSRKFPSALPIWARPDYNPPLLESWKDPDYVPPVVHGCPLPPTKAPPIPPPRRKRTVVLTESNVSSALAELATKTFGSSGSSAVDSGTATALPDLASDDGDKGSDVESYSSMPPLEGEPGDPDLSDGSWSTVSEEASEDVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 92 - protein, 3033 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCGGSWLRDVWDWVCTILTDFKNWLTSKLFPKMPGLPFVSCQKGYKGVWAGTGIMTTRCPCGANISGNVRLGSMRITGPKTCMNIWQGTFPINCYTEGQCVPKPAPNFKVAIWRVAASEYAEVTQHGSYHYITGLTTDNLKVPCQLPSPEFFSWVDGVQIHRFAPTPKPFFRDEVSFCVGLNSFVVGSQLPCDPEPDTDVLMSMLTDPSHITAETAARRLARGSPPSEASSSASQLSAPSLRATCTTHGKAYDVDMVDANLFMGGDVTRIESGSKVVVLDSLDPMVEERSDLEPSIPSEYMLPKKRFPPALPAWARPDYNPPLVESWKRPDYQPATVAGCALPPPRKTPTPPPRRRRTVGLSEDSIGDALQQLAIKSFGQPPPSGDSGLSTGAGAADSGSQTPPDELALSETGSISSMPPLEGELGDPDLEPEQVEPQPPPQGGVAAPGSDSGSWSTCSEEDDSVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 93 - protein, 3033 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFSVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCGGSWLRDVWDWVCTILTDFKNWLTSKLFPKMPGLPFVSCQKGYKGVWAGTGIMTTRCPCGANISGNVRLGSMRITGPKTCMNIWQGTFPINCYTEGQCVPKPAPNFKVAIWRVAASEYAEVTQHGSYHYITGLTTDNLKVPCQLPSPEFFSWVDGVQIHRFAPTPKPFFRDEVSFCVGLNSFVVGSQLPCDPEPDTDVLMSMLTDPSHITAETAARRLARGSPPSEASSSASQLSAPSLRATCTTHGKAYDVDMVDANLFMGGDVTRIESGSKVVVLDSLDPMVEERSDLEPSIPSEYMLPKKRFPPALPAWARPDYNPPLVESWKRPDYQPATVAGCALPPPRKTPTPPPRRRRTVGLSEDSIGDALQQLAIKSFGQPPPSGDSGLSTGAGAADSGSQTPPDELALSETGSISSMPPLEGELGDPDLEPEQVEPQPPPQGGVAAPGSDSGSWSTCSEEDDSVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 94 - protein, 3019 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGDWLRDIWDWVCSVLSDFKTWLSAKIMPALPGLPFISCQKGYKGVWRGDGVMSTRCPCGASITGHVKNGSMRLAGPRMCANMWHGTFPINEYTTGPSTPCPSPNYTRALWRVAASSYVEVRRVGDFHYITGATEDELKCPCQVPAAEFFTEVDGVRLHRYAPPCKPLLREEITFSVGLHSYAIGSQLPCEPEPDVSVLTSMLRDPSHITAETAARRLARGSPPSEASSSASQLSAPSLKATCQTHRPHPDAELVDANLLWRQEMGSNITRVESETKVVILDSFEPLRAEADDAELSVAAECFKKPPKYPPALPIWARPDYNPPLLDRWKAPDYVPPTVHGCALPPRGAPPVPPPRRKRTIQLDGSNVSAALAALAEKSFPTPKSQEENSSSSGVDTQSSTTSRMPPSPGGESDSESCSSMPPLEGEPGDPDLSCDSWSTVSDNEEQSVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 95 - protein, 3019 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFSVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGDWLRDIWDWVCSVLSDFKTWLSAKIMPALPGLPFISCQKGYKGVWRGDGVMSTRCPCGASITGHVKNGSMRLAGPRMCANMWHGTFPINEYTTGPSTPCPSPNYTRALWRVAASSYVEVRRVGDFHYITGATEDELKCPCQVPAAEFFTEVDGVRLHRYAPPCKPLLREEITFSVGLHSYAIGSQLPCEPEPDVSVLTSMLRDPSHITAETAARRLARGSPPSEASSSASQLSAPSLKATCQTHRPHPDAELVDANLLWRQEMGSNITRVESETKVVILDSFEPLRAEADDAELSVAAECFKKPPKYPPALPIWARPDYNPPLLDRWKAPDYVPPTVHGCALPPRGAPPVPPPRRKRTIQLDGSNVSAALAALAEKSFPTPKSQEENSSSSGVDTQSSTTSRMPPSPGGESDSESCSSMPPLEGEPGDPDLSCDSWSTVSDNEEQSVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 96 - protein, 3019 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGGVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGDWLRDIWDWVCSVLSDFKTWLSAKIMPALPGLPFISCQKGYKGVWRGDGVMSTRCPCGASITGHVKNGSMRLAGPRMCANMWHGTFPINEYTTGPSTPCPSPNYTRALWRVAASSYVEVRRVGDFHYITGATEDELKCPCQVPAAEFFTEVDGVRLHRYAPPCKPLLREEITFSVGLHSYAIGSQLPCEPEPDVSVLTSMLRDPSHITAETAARRLARGSPPSEASSSASQLSAPSLKATCQTHRPHPDAELVDANLLWRQEMGSNITRVESETKVVILDSFEPLRAEADDAELSVAAECFKKPPKYPPALPIWARPDYNPPLLDRWKAPDYVPPTVHGCALPPRGAPPVPPPRRKRTIQLDGSNVSAALAALAEKSFPTPKSQEENSSSSGVDTQSSTTSRMPPSPGGESDSESCSSMPPLEGEPGDPDLSCDSWSTVSDNEEQSVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 97 - protein, 3019 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLSAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGDWLRDIWDWVCSVLSDFKTWLSAKIMPALPGLPFISCQKGYKGVWRGDGVMSTRCPCGASITGHVKNGSMRLAGPRMCANMWHGTFPINEYTTGPSTPCPSPNYTRALWRVAASSYVEVRRVGDFHYITGATEDELKCPCQVPAAEFFTEVDGVRLHRYAPPCKPLLREEITFSVGLHSYAIGSQLPCEPEPDVSVLTSMLRDPSHITAETAARRLARGSPPSEASSSASQLSAPSLKATCQTHRPHPDAELVDANLLWRQEMGSNITRVESETKVVILDSFEPLRAEADDAELSVAAECFKKPPKYPPALPIWARPDYNPPLLDRWKAPDYVPPTVHGCALPPRGAPPVPPPRRKRTIQLDGSNVSAALAALAEKSFPTPKSQEENSSSSGVDTQSSTTSRMPPSPGGESDSESCSSMPPLEGEPGDPDLSCDSWSTVSDNEEQSVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 98 - protein, 3019 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSPGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGDWLRDIWDWVCSVLSDFKTWLSAKIMPALPGLPFISCQKGYKGVWRGDGVMSTRCPCGASITGHVKNGSMRLAGPRMCANMWHGTFPINEYTTGPSTPCPSPNYTRALWRVAASSYVEVRRVGDFHYITGATEDELKCPCQVPAAEFFTEVDGVRLHRYAPPCKPLLREEITFSVGLHSYAIGSQLPCEPEPDVSVLTSMLRDPSHITAETAARRLARGSPPSEASSSASQLSAPSLKATCQTHRPHPDAELVDANLLWRQEMGSNITRVESETKVVILDSFEPLRAEADDAELSVAAECFKKPPKYPPALPIWARPDYNPPLLDRWKAPDYVPPTVHGCALPPRGAPPVPPPRRKRTIQLDGSNVSAALAALAEKSFPTPKSQEENSSSSGVDTQSSTTSRMPPSPGGESDSESCSSMPPLEGEPGDPDLSCDSWSTVSDNEEQSVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 99 - protein, 3019 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGGWLRDIWDWVCSVLSDFKTWLSAKIMPALPGLPFISCQKGYKGVWRGDGVMSTRCPCGASITGHVKNGSMRLAGPRMCANMWHGTFPINEYTTGPSTPCPSPNYTRALWRVAASSYVEVRRVGDFHYITGATEDELKCPCQVPAAEFFTEVDGVRLHRYAPPCKPLLREEITFSVGLHSYAIGSQLPCEPEPDVSVLTSMLRDPSHITAETAARRLARGSPPSEASSSASQLSAPSLKATCQTHRPHPDAELVDANLLWRQEMGSNITRVESETKVVILDSFEPLRAEADDAELSVAAECFKKPPKYPPALPIWARPDYNPPLLDRWKAPDYVPPTVHGCALPPRGAPPVPPPRRKRTIQLDGSNVSAALAALAEKSFPTPKSQEENSSSSGVDTQSSTTSRMPPSPGGESDSESCSSMPPLEGEPGDPDLSCDSWSTVSDNEEQSVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 100 - protein, 3019 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGDWLRDIWDWVCSVLSDFKTWLSAKIMPALPGLPFISCQKGYKGVWRGDGVMSTRCPCGASITGHVKNGSMRLAGPRMCANMWHGTFPINEYTTGPSTPCPSPNYTRALWRVAASSYVEVRRVGDFHYITGATEDELKCPCQVPAAEFFTEVDGVRLHRYAPPCKPLLREEITFSVGLHSYAIGSQLPCEPEPDVSVLTSMLRDPSHITAETAARRLARGSPPSEASSSASQLSAPSLKATCQTHRPHPDAELVDANLLWRQEMGSNITRVESETKVVILDSFEPLRAEADDAELSVAAECFKKPPKYPPALPIWARPDYNPPLLDRWKAPDYVPPTVHGCALPPRGAPPVPPPRRKRTIQLDGSNVSAALAALAEKSFPTPKSQEENSSSSGVDTQSSTTSRMPPSPGGESDSESCSSMPPLEGEPGDPDLSCDSRSTVSDNEEQSVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 101 - protein, 3019 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGGVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSPGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGDWLRDIWDWVCSVLSDFKTWLSAKIMPALPGLPFISCQKGYKGVWRGDGVMSTRCPCGASITGHVKNGSMRLAGPRMCANMWHGTFPINEYTTGPSTPCPSPNYTRALWRVAASSYVEVRRVGDFHYITGATEDELKCPCQVPAAEFFTEVDGVRLHRYAPPCKPLLREEITFSVGLHSYAIGSQLPCEPEPDVSVLTSMLRDPSHITAETAARRLARGSPPSEASSSASQLSAPSLKATCQTHRPHPDAELVDANLLWRQEMGSNITRVESETKVVILDSFEPLRAEADDAELSVAAECFKKPPKYPPALPIWARPDYNPPLLDRWKAPDYVPPTVHGCALPPRGAPPVPPPRRKRTIQLDGSNVSAALAALAEKSFPTPKSQEENSSSSGVDTQSSTTSRMPPSPGGESDSESCSSMPPLEGEPGDPDLSCDSWSTVSDNEEQSVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 102 - protein, 3019 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGGVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGGWLRDIWDWVCSVLSDFKTWLSAKIMPALPGLPFISCQKGYKGVWRGDGVMSTRCPCGASITGHVKNGSMRLAGPRMCANMWHGTFPINEYTTGPSTPCPSPNYTRALWRVAASSYVEVRRVGDFHYITGATEDELKCPCQVPAAEFFTEVDGVRLHRYAPPCKPLLREEITFSVGLHSYAIGSQLPCEPEPDVSVLTSMLRDPSHITAETAARRLARGSPPSEASSSASQLSAPSLKATCQTHRPHPDAELVDANLLWRQEMGSNITRVESETKVVILDSFEPLRAEADDAELSVAAECFKKPPKYPPALPIWARPDYNPPLLDRWKAPDYVPPTVHGCALPPRGAPPVPPPRRKRTIQLDGSNVSAALAALAEKSFPTPKSQEENSSSSGVDTQSSTTSRMPPSPGGESDSESCSSMPPLEGEPGDPDLSCDSWSTVSDNEEQSVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 103 - protein, 3019 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGGVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGDWLRDIWDWVCSVLSDFKTWLSAKIMPALPGLPFISCQKGYKGVWRGDGVMSTRCPCGASITGHVKNGSMRLAGPRMCANMWHGTFPINEYTTGPSTPCPSPNYTRALWRVAASSYVEVRRVGDFHYITGATEDELKCPCQVPAAEFFTEVDGVRLHRYAPPCKPLLREEITFSVGLHSYAIGSQLPCEPEPDVSVLTSMLRDPSHITAETAARRLARGSPPSEASSSASQLSAPSLKATCQTHRPHPDAELVDANLLWRQEMGSNITRVESETKVVILDSFEPLRAEADDAELSVAAECFKKPPKYPPALPIWARPDYNPPLLDRWKAPDYVPPTVHGCALPPRGAPPVPPPRRKRTIQLDGSNVSAALAALAEKSFPTPKSQEENSSSSGVDTQSSTTSRMPPSPGGESDSESCSSMPPLEGEPGDPDLSCDSRSTVSDNEEQSVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 104 - protein, 3019 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGGVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSPGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGGWLRDIWDWVCSVLSDFKTWLSAKIMPALPGLPFISCQKGYKGVWRGDGVMSTRCPCGASITGHVKNGSMRLAGPRMCANMWHGTFPINEYTTGPSTPCPSPNYTRALWRVAASSYVEVRRVGDFHYITGATEDELKCPCQVPAAEFFTEVDGVRLHRYAPPCKPLLREEITFSVGLHSYAIGSQLPCEPEPDVSVLTSMLRDPSHITAETAARRLARGSPPSEASSSASQLSAPSLKATCQTHRPHPDAELVDANLLWRQEMGSNITRVESETKVVILDSFEPLRAEADDAELSVAAECFKKPPKYPPALPIWARPDYNPPLLDRWKAPDYVPPTVHGCALPPRGAPPVPPPRRKRTIQLDGSNVSAALAALAEKSFPTPKSQEENSSSSGVDTQSSTTSRMPPSPGGESDSESCSSMPPLEGEPGDPDLSCDSRSTVSDNEEQSVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 105 - protein, 3012 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCAESWLWEVWDWVCTVLSDFKTWLKAKLLPLMPGIPFLSCQRGYKGEWRGDGVMHTTCPCGADLAGHIKNGSMRITGPKTCSNTWHGTFPINAYTTGPGVPIPAPNYKFALWRVSAEDYVEVRRVGDFHYVTGVTQDNIKCPCQVPAPEFFTEVDGIRLHRHAPKCKPLLRDEVSFSVGLNSFVVGSQLPCEPEPDVAVLTSMLTDPSHITAESARRRLARGSRPSLASSSASQLSAPSLKATCTAPHDSPGTDLLEANLLWGSTATRVETDEKVIILDSFESCVAEPNDDREVSVAAEILRPTKKFPPALPIWARPDYNPPLTETWKQQDYKPPTVHGCALPPGKQPPVPPPRRKRTVQLTESVVSTALAELAAKTFGQSEPSSDRDTDLTTPTETTDSGPIVVDDASDDGSYSSMPPLEGEPGDPDLTSDSWSTVSGSEDVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 106 - protein, 3012 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFSVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCAESWLWEVWDWVCTVLSDFKTWLKAKLLPLMPGIPFLSCQRGYKGEWRGDGVMHTTCPCGADLAGHIKNGSMRITGPKTCSNTWHGTFPINAYTTGPGVPIPAPNYKFALWRVSAEDYVEVRRVGDFHYVTGVTQDNIKCPCQVPAPEFFTEVDGIRLHRHAPKCKPLLRDEVSFSVGLNSFVVGSQLPCEPEPDVAVLTSMLTDPSHITAESARRRLARGSRPSLASSSASQLSAPSLKATCTAPHDSPGTDLLEANLLWGSTATRVETDEKVIILDSFESCVAEPNDDREVSVAAEILRPTKKFPPALPIWARPDYNPPLTETWKQQDYKPPTVHGCALPPGKQPPVPPPRRKRTVQLTESVVSTALAELAAKTFGQSEPSSDRDTDLTTPTETTDSGPIVVDDASDDGSYSSMPPLEGEPGDPDLTSDSWSTVSGSEDVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 107 - protein, 3012 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKHIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCAESWLWEVWDWVCTVLSDFKTWLKAKLLPLMPGIPFLSCQRGYKGEWRGDGVMHTTCPCGADLAGHIKNGSMRITGPKTCSNTWHGTFPINAYTTGPGVPIPAPNYKFALWRVSAEDYVEVRRVGDFHYVTGVTQDNIKCPCQVPAPEFFTEVDGIRLHRHAPKCKPLLRDEVSFSVGLNSFVVGSQLPCEPEPDVAVLTSMLTDPSHITAESARRRLARGSRPSLASSSASQLSAPSLKATCTAPHDSPGTDLLEANLLWGSTATRVETDEKVIILDSFESCVAEPNDDREVSVAAEILRPTKKFPPALPIWARPDYNPPLTETWKQQDYKPPTVHGCALPPGKQPPVPPPRRKRTVQLTESVVSTALAELAAKTFGQSEPSSDRDTDLTTPTETTDSGPIVVDDASDDGSYSSMPPLEGEPGDPDLTSDSWSTVSGSEDVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 108 - protein, 3012 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCAESWLWEVWDWVCTVLSDFKTWLKAKLLPLMPGIPFLSCQRGYKGEWRGDGVMHTTCPCGADLAGHIKNGSMRITGPKTCSNTWHGTFPINAYTTGPGVPIPAPNYKFALWRVSAEDYVEVRRVGDFHYVTGVTQDNIKCPCQVPAPEFFTEVDGIRLHRHAPKCKPLLRDEVSFSVGLNSFVVGSQLPCEPEPDVAVLTSMLTDPSHITAESARRRLARGSRPSLASSSASQLSAPSLKATCTAPHDSPGTDLLEANLLWGSTATRVETDEKVIILDSFESCVAEPNDDRGVSVAAEILRPTKKFPPALPIWARPDYNPPLTETWKQQDYKPPTVHGCALPPGKQPPVPPPRRKRTVQLTESVVSTALAELAAKTFGQSEPSSDRDTDLTTPTETTDSGPIVVDDASDDGSYSSMPPLEGEPGDPDLTSDSWSTVSGSEDVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 109 - protein, 3012 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCAESWLWEVWDWVCTVLSDFKTWLKAKLLPLMPGIPFLSCQRGYKGEWRGDGVMHTTCPCGADLAGHIKNGSMRITGPKTCSNTWHGTFPINAYTTGPGVPIPAPNYKFALWRVSAEDYVEVRRVGDFHYVTGVTQDNIKCPCQVPAPEFFTEVDGIRLHRHAPKCKPLLRDEVSFSVGLNSFVVGSQLPCEPEPDVAVLTSMLTDPSHITAESARRRLARGSRPSLASSSASQLSAPSLKATCTAPHDSPGTDLLEANLLWGSTATRVETDEKVIILDSFESCVAEPNDDREVSVAAEILRPTKKFPPALPIWARPDYNPPLTETWKQQDYKPPTVHGCALPPGKQPPVPPPRRKRTVQLTESVVSTALAELAAKTFGQSEPSSDRDTDLTTPTETTDSGPIVVDDASDDGSYSSMPPLEGEPGDPDLTSDSWSTVSGSGDVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 110 - protein, 3012 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFSVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKHIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCAESWLWEVWDWVCTVLSDFKTWLKAKLLPLMPGIPFLSCQRGYKGEWRGDGVMHTTCPCGADLAGHIKNGSMRITGPKTCSNTWHGTFPINAYTTGPGVPIPAPNYKFALWRVSAEDYVEVRRVGDFHYVTGVTQDNIKCPCQVPAPEFFTEVDGIRLHRHAPKCKPLLRDEVSFSVGLNSFVVGSQLPCEPEPDVAVLTSMLTDPSHITAESARRRLARGSRPSLASSSASQLSAPSLKATCTAPHDSPGTDLLEANLLWGSTATRVETDEKVIILDSFESCVAEPNDDREVSVAAEILRPTKKFPPALPIWARPDYNPPLTETWKQQDYKPPTVHGCALPPGKQPPVPPPRRKRTVQLTESVVSTALAELAAKTFGQSEPSSDRDTDLTTPTETTDSGPIVVDDASDDGSYSSMPPLEGEPGDPDLTSDSWSTVSGSEDVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 111 - protein, 3012 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFSVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCAESWLWEVWDWVCTVLSDFKTWLKAKLLPLMPGIPFLSCQRGYKGEWRGDGVMHTTCPCGADLAGHIKNGSMRITGPKTCSNTWHGTFPINAYTTGPGVPIPAPNYKFALWRVSAEDYVEVRRVGDFHYVTGVTQDNIKCPCQVPAPEFFTEVDGIRLHRHAPKCKPLLRDEVSFSVGLNSFVVGSQLPCEPEPDVAVLTSMLTDPSHITAESARRRLARGSRPSLASSSASQLSAPSLKATCTAPHDSPGTDLLEANLLWGSTATRVETDEKVIILDSFESCVAEPNDDRGVSVAAEILRPTKKFPPALPIWARPDYNPPLTETWKQQDYKPPTVHGCALPPGKQPPVPPPRRKRTVQLTESVVSTALAELAAKTFGQSEPSSDRDTDLTTPTETTDSGPIVVDDASDDGSYSSMPPLEGEPGDPDLTSDSWSTVSGSEDVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 112 - protein, 3012 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFSVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCAESWLWEVWDWVCTVLSDFKTWLKAKLLPLMPGIPFLSCQRGYKGEWRGDGVMHTTCPCGADLAGHIKNGSMRITGPKTCSNTWHGTFPINAYTTGPGVPIPAPNYKFALWRVSAEDYVEVRRVGDFHYVTGVTQDNIKCPCQVPAPEFFTEVDGIRLHRHAPKCKPLLRDEVSFSVGLNSFVVGSQLPCEPEPDVAVLTSMLTDPSHITAESARRRLARGSRPSLASSSASQLSAPSLKATCTAPHDSPGTDLLEANLLWGSTATRVETDEKVIILDSFESCVAEPNDDREVSVAAEILRPTKKFPPALPIWARPDYNPPLTETWKQQDYKPPTVHGCALPPGKQPPVPPPRRKRTVQLTESVVSTALAELAAKTFGQSEPSSDRDTDLTTPTETTDSGPIVVDDASDDGSYSSMPPLEGEPGDPDLTSDSWSTVSGSGDVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 113 - protein, 3012 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFSVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKHIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCAESWLWEVWDWVCTVLSDFKTWLKAKLLPLMPGIPFLSCQRGYKGEWRGDGVMHTTCPCGADLAGHIKNGSMRITGPKTCSNTWHGTFPINAYTTGPGVPIPAPNYKFALWRVSAEDYVEVRRVGDFHYVTGVTQDNIKCPCQVPAPEFFTEVDGIRLHRHAPKCKPLLRDEVSFSVGLNSFVVGSQLPCEPEPDVAVLTSMLTDPSHITAESARRRLARGSRPSLASSSASQLSAPSLKATCTAPHDSPGTDLLEANLLWGSTATRVETDEKVIILDSFESCVAEPNDDRGVSVAAEILRPTKKFPPALPIWARPDYNPPLTETWKQQDYKPPTVHGCALPPGKQPPVPPPRRKRTVQLTESVVSTALAELAAKTFGQSEPSSDRDTDLTTPTETTDSGPIVVDDASDDGSYSSMPPLEGEPGDPDLTSDSWSTVSGSEDVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 114 - protein, 3017 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCDGTWLRAIWDWVCTALTDFKAWLQAKLLPQLPGVPFLSCQRGYKGVWRGDGVNSTKCPCGATISGHVKNGTMRIVGPKLCSNTWHGTFPINATTTGPSVPAPAPNYKFALWRVGAADYAEVRRVGDYHYITGVTQDNLKCPCQVPSPEFFTELDGVRIHRYAPPCNPLLREEVCFSVGLHSFVVGSQLPCEPEPDVTVLTSMLSDPAHITAETAKRRLDRGSPPSLASSSASQLSAPSLKATCTTQGHHPDADLIEANLLWRQCMGGNITRVEAENKVVILDSFEPLKADDDDREISVSADCFRRGPAFPPALPVWARPGYDPPLLETWKQPDYDPPQVSGCPLPPAGLPPVPPPRRKRKPVVLSDSNVSQVLADLAHARFKADTQSIEGQDSAVGTSSQPDSGPEEKRDDDSDAASYSSMPPLEGEPGDPDLSSGSWSTVSDEDSVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 115 - protein, 3017 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFSVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCDGTWLRAIWDWVCTALTDFKAWLQAKLLPQLPGVPFLSCQRGYKGVWRGDGVNSTKCPCGATISGHVKNGTMRIVGPKLCSNTWHGTFPINATTTGPSVPAPAPNYKFALWRVGAADYAEVRRVGDYHYITGVTQDNLKCPCQVPSPEFFTELDGVRIHRYAPPCNPLLREEVCFSVGLHSFVVGSQLPCEPEPDVTVLTSMLSDPAHITAETAKRRLDRGSPPSLASSSASQLSAPSLKATCTTQGHHPDADLIEANLLWRQCMGGNITRVEAENKVVILDSFEPLKADDDDREISVSADCFRRGPAFPPALPVWARPGYDPPLLETWKQPDYDPPQVSGCPLPPAGLPPVPPPRRKRKPVVLSDSNVSQVLADLAHARFKADTQSIEGQDSAVGTSSQPDSGPEEKRDDDSDAASYSSMPPLEGEPGDPDLSSGSWSTVSDEDSVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 116 - protein, 3017 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCDGTWLGAIWDWVCTALTDFKAWLQAKLLPQLPGVPFLSCQRGYKGVWRGDGVNSTKCPCGATISGHVKNGTMRIVGPKLCSNTWHGTFPINATTTGPSVPAPAPNYKFALWRVGAADYAEVRRVGDYHYITGVTQDNLKCPCQVPSPEFFTELDGVRIHRYAPPCNPLLREEVCFSVGLHSFVVGSQLPCEPEPDVTVLTSMLSDPAHITAETAKRRLDRGSPPSLASSSASQLSAPSLKATCTTQGHHPDADLIEANLLWRQCMGGNITRVEAENKVVILDSFEPLKADDDDREISVSADCFRRGPAFPPALPVWARPGYDPPLLETWKQPDYDPPQVSGCPLPPAGLPPVPPPRRKRKPVVLSDSNVSQVLADLAHARFKADTQSIEGQDSAVGTSSQPDSGPEEKRDDDSDAASYSSMPPLEGEPGDPDLSSGSWSTVSDEDSVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 117 - protein, 3017 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCDGTWLGAIWDWVCTALTDFKAWLQAKLLPQLPGVPFLSCQRGYKGVWRGDGVNSTKCPCGATISGHVKNGTMRIVGPKLCSNTWHGTFPINATTTGPSVPAPAPNYKFALWRVGAADYAEVRRVGDYHYITGVTQDNLKCPCQVPSPEFFTELDGVRIHRYAPPCNPLLREEVCFSVGLHSFVVGSQLPCEPEPDVTVLTSMLSDPAHITAETAKRRLDRGSPPSLASSSASQLSAPSLKATCTTQGHHPDVDLIEANLLWRQCMGGNITRVEAENKVVILDSFEPLKADDDDREISVSADCFRRGPAFPPALPVWARPGYDPPLLETWKQPDYDPPQVSGCPLPPAGLPPVPPPRRKRKPVVLSDSNVSQVLADLAHARFKADTQSIEGQDSAVGTSSQPDSGPEEKRDDDSDAASYSSMPPLEGEPGDPDLSSGSWSTVSDEDSVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 118 - protein, 3017 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCDGTWLGAIWDWVCTALTDFKAWLQAKLLPQLPGVPFLSCQRGYKGVWRGDGVNSTKCPCGATISGHVKNGTMRIVGPKLCSNTWHGTFPINATTTGPSVPAPAPNYKFALWRVGAADYAEVRRVGDYHYITGVTQDNLKCPCQVPSPEFFTELDGVRIHRYAPPCNPLLREEVCFSVGLHSFVVGSQLPCEPEPDVTVLTSMLSDPAHITAETAKRRLDRGSPPSLASSSASQLSAPSLKATCTTQGHHPDADLIEANLLWRQCMGGNITRVEAENKVVILDSFEPLKADDDDREISVSADCFRRGPAFPPALPVWARPGYDPPLLETWKQPDYDPLQVSGCPLPPAGLPPVPPPRRKRKPVVLSDSNVSQVLADLAHARFKADTQSIEGQDSAVGTSSQPDSGPEEKRDDDSDAASYSSMPPLEGEPGDPDLSSGSWSTVSDEDSVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 119 - protein, 3017 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCDGTWLGAIWDWVCTALTDFKAWLQAKLLPQLPGVPFLSCQRGYKGVWRGDGVNSTKCPCGATISGHVKNGTMRIVGPKLCSNTWHGTFPINATTTGPSVPAPAPNYKFALWRVGAADYAEVRRVGDYHYITGVTQDNLKCPCQVPSPEFFTELDGVRIHRYAPPCNPLLREEVCFSVGLHSFVVGSQLPCEPEPDVTVLTSMLSDPAHITAETAKRRLDRGSPPSLASSSASQLSAPSLKATCTTQGHHPDADLIEANLLWRQCMGGNITRVEAENKVVILDSFEPLKADDDDREISVSADCFRRGPAFPPALPVWARPGYDPPLLETWKQPDYDPPQVSGCPLPPAGLPPVPPPRRKRKPVVLSDSNVSQVLADLAHARFKADTQSIEGQDSAVGTSSQPDSGPEEKRDDDSDAASYSSMPPLEGEPGDPDLSSGSWSTVSDEDGVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 120 - protein, 3017 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFSVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCDGTWLGAIWDWVCTALTDFKAWLQAKLLPQLPGVPFLSCQRGYKGVWRGDGVNSTKCPCGATISGHVKNGTMRIVGPKLCSNTWHGTFPINATTTGPSVPAPAPNYKFALWRVGAADYAEVRRVGDYHYITGVTQDNLKCPCQVPSPEFFTELDGVRIHRYAPPCNPLLREEVCFSVGLHSFVVGSQLPCEPEPDVTVLTSMLSDPAHITAETAKRRLDRGSPPSLASSSASQLSAPSLKATCTTQGHHPDADLIEANLLWRQCMGGNITRVEAENKVVILDSFEPLKADDDDREISVSADCFRRGPAFPPALPVWARPGYDPPLLETWKQPDYDPPQVSGCPLPPAGLPPVPPPRRKRKPVVLSDSNVSQVLADLAHARFKADTQSIEGQDSAVGTSSQPDSGPEEKRDDDSDAASYSSMPPLEGEPGDPDLSSGSWSTVSDEDSVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 121 - protein, 3018 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCATSWLRDVWDWVCTVLSDFRVWLKAKLLPRLPGIPFLSCQTGYRGVWAGDGVCHTTCTCGAVIAGHVKNGTMKITGPKTCSNTWHGTFPINATTTGPSTPRPAPNYQRALWRVSAEDYVEVRRLGDCHYVVGVTAEGLKCPCQVPAPEFFTEVDGVRIHRYAPPCKPLLRDEVTFSVGLSSYAIGSQLPCEPEPDVTVVTSMLTDPTHITAETAARRLKRGSPPSLASSSASQLSAPSLKATCTTSKDHPDMELIEANLLWRQEMGGNITRVESENKVVILDSFEPLTAEYDEREISVSAECHRPPRRKFPPALPIWARPDYNPPLIQAWQMPGYEPPVVSGCAVAPPKPAPIPPPRRKRLVHLDESTVSHALAQLADKVFVESSSDPGPSSDSGLSIASPVPPAPTTPDDACSEAGSYSSMPPLEGEPGDPDLSSGSWSTVSDQDDVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 122 - protein, 3018 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFSVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCATSWLRDVWDWVCTVLSDFRVWLKAKLLPRLPGIPFLSCQTGYRGVWAGDGVCHTTCTCGAVIAGHVKNGTMKITGPKTCSNTWHGTFPINATTTGPSTPRPAPNYQRALWRVSAEDYVEVRRLGDCHYVVGVTAEGLKCPCQVPAPEFFTEVDGVRIHRYAPPCKPLLRDEVTFSVGLSSYAIGSQLPCEPEPDVTVVTSMLTDPTHITAETAARRLKRGSPPSLASSSASQLSAPSLKATCTTSKDHPDMELIEANLLWRQEMGGNITRVESENKVVILDSFEPLTAEYDEREISVSAECHRPPRRKFPPALPIWARPDYNPPLIQAWQMPGYEPPVVSGCAVAPPKPAPIPPPRRKRLVHLDESTVSHALAQLADKVFVESSSDPGPSSDSGLSIASPVPPAPTTPDDACSEAGSYSSMPPLEGEPGDPDLSSGSWSTVSDQDDVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 123 - protein, 3018 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCATSWLRDVWDWVCTVLSDFRVWLKAKLLPRLPGIPFLSCQTGYRGVWAGDGVCHTTCTCGAVIAGHVKNGTMKITGPKTCSNTWHGTFPINATTTGPSTPRPAPNYQRALWRVSAEDYVEVRRLGDCHYVVGVTAEGLKCPCQVPAPEFFTEVDGVRIHRYAPPCKPLLRDEVTFSVGLSSYAIGSQLPCEPEPDVTVVTSMLTDPTHITAETAARRLKRGSPPSLASSSASQLSAPSLKATCTTSKDHPDMELIEANLLWRQEMGGNITRVESENKVVILDSFEPLTAEYDERENSVSAECHRPPRRKFPPALPIWARPDYNPPLIQAWQMPGYEPPVVSGCAVAPPKPAPIPPPRRKRLVHLDESTVSHALAQLADKVFVESSSDPGPSSDSGLSIASPVPPAPTTPDDACSEAGSYSSMPPLEGEPGDPDLSSGSWSTVSDQDDVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 124 - protein, 3013 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCAGSWLREVWDWVCMVLSDFASWLKAKVLPSLPGIPFLSCQKGYKGEWRNDGIMNTKCPCGALIAGHVKNGSMRIVGPKTCRNTWWGTFPINSHTTGPSSPVPSHCYQRALWRVSATEYVEILRHNDQHYVVGVTAEDLKCPCQVPSPEFFSFVDGVRIHRFAPEPKPMIREEAAFVVGLHSYVVGSQLPCEPEPDVQTVSQLLTDPSHITAETAARRLRRGSPPSNASSSASQLSAPSLKATHTTLPQHPDAELIEANLMWEHKVGAIRRMETDTKVIILDSFDSASSVEDDMEPSTAAECLRTRKVFPPAMPIWARPDYNPPVVENWKDPEYAPPQVSGCALPPAQTPPVPPPRRKRAVIQLTESAVSTALAELAERSFPKEEAPPSDSAISLDSPAANDPPSDCDQGSEISFSSMPPLEGEPGDPDLSDGSWSTVSTRSDVICCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 125 - protein, 3011 aa, Hepatitis C virus
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAYQVRNSSGLYHVTNDCPNSSIVYEAADAILHTPGCVPCVREGNASRCWVAVTPTVATRDGKLPTTQLRRHIDLLVGSATLCSALYVGDLCGSVFLVGQLFTFSPRRHWTTQDCNCSIYPGHITGHRMAWDMMMNWSPTAALVVAQLLRIPQAIMDMIAGAHWGVLAGIAYFSMVGNWAKVLVVLLLFAGVDAETHVTGGNAGRTTAGLVGLLTPGAKQNIQLINTNGSWHINSTALNCNESLNTGWLAGLFYQHKFNSSGCPERLASCRRLTDFAQGWGPISYANGSGLDERPYCWHYPPRPCGIVPAKSVCGPVYCFTPSPVVVGTTDRSGAPTYSWGANDTDVFVLNNTRPPLGNWFGCTWMNSTGFTKVCGAPPCVIGGVGNNTLLCPTDCFRKHPEATYSRCGSGPWITPRCMVDYPYRLWHYPCTINYTIFKVRMYVGGVEHRLEAACNWTRGERCDLEDRDRSELSPLLLSTTQWQVLPCSFTTLPALSTGLIHLHQNIVDVQYLYGVGSSIASWAIKWEYVVLLFLLLADARVCSCLWMMLLISQAEAALENLVILNAASLAGTHGLVSFLVFFCFAWYLKGRWVPGAAYALYGMWPLLLLLLALPQRAYALDTEVAASCGGVVLVGLMALTLSPYYKRYISWCMWWLQYFLTRVEAQLHVWVPPLNVRGGRDAVILLMCVVHPTLVFDITKLLLAIFGPLWILQASLLKVPYFVRVQGLLRICALARKIAGGHYVQMAIIKLGALTGTYVYNHLTPLRDWAHNGLRDLAVAVEPVVFSRMETKLITWGADTAACGDIINGLPVSARRGQEILLGPADGMVSKGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAALGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDIWDWICEVLSDFKTWLKAKLMPQLPGIPFVSCQRGYRGVWRGDGIMHTRCHCGAEITGHVKNGTMRIVGPRTCRNMWSGTFPINAYTTGPCTPLPAPNYKFALWRVSAEEYVEIRRVGDFHYVSGMTTDNLKCPCQIPSPEFFTELDGVRLHRFAPPCKPLLREEVSFRVGLHEYPVGSQLPCEPEPDVAVLTSMLTDPSHITAEAAGRRLARGSPPSMASSSASQLSAPSLKATCTANHDSPDAELIEANLLWRQEMGGNITRVESENKVVILDSFDPLVAEEDEREVSVPAEILRKSRRFARALPVWARPDYNPPLVETWKKPDYEPPVVHGCPLPPPRSPPVPPPRKKRTVVLTESTLSTALAELATKSFGSSSTSGITGDNTTTSSEPAPSGCPPDSDVESYSSMPPLEGEPGDPDLSDGSWSTVSSGADTEDVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 126 - protein, 3011 aa, Hepatitis C virus
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAYQVRNSSGLYHVTNDCPNSSIVYEAADAILHTPGCVPCVREGNASRCWVAVTPTVATRDGKLPTTQLRRHIDLLVGSATLCSALYVGDLCGSVFLVGQLFTFSPRRHWTTQDCNCSIYPGHITGHRMAWDMMMNWSPTAALVVAQLLRIPQAIMDMIAGAHWGVLAGIAYFSMVGNWAKVLVVLLLFAGVDAETHVTGGNAGRTTAGLVGLLTPGAKQNIQLINTNGSWHINSTALNCNESLNTGWLAGLFYQHKFNSSGCPERLASCRRLTDFAQGWGPISYANGSGLDERPYCWHYPPRPCGIVPAKSVCGPVYCFTPSPVVVGTTDRSGAPTYSWGANDTDVFVLNNTRPPLGNWFGCTWMNSTGFTKVCGAPPCVIGGVGNNTLLCPTDCFRKHPEATYSRCGSGPWITPRCMVDYPYRLWHYPCTINYTIFKVRMYVGGVEHRLEAACNWTRGERCDLEDRDRSELSPLLLSTTQWQVLPCSFTTLPALSTGLIHLHQNIVDVQYLYGVGSSIASWAIKWEYVVLLFLLLADARVCSCLWMMLLISQAEAALENLVILNAASLAGTHGLVSFLVFFCFAWYLKGRWVPGAAYALYGMWPLLLLLLALPQRAYALDTEVAASCGGVVLVGLMALTLSPYYKRYISWCMWWLQYFLTRVEAQLHVWVPPLNVRGGRDAVILLMCVVHPTLVFDITKLLLAIFGPLWILQASLLKVPYFVRVQGLLRICALARKIAGGHYVQMAIIKLGALTGTYVYNHLTPLRDWAHNGLRDLAVAVEPVVFSRMETKLITWGADTAACGDIINGLPVSARRGQEILLGPADGMVSKGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVSSRGVAKSIDFIPVETLDVVTRSPTFSDNSTPPAVPQTYQVGYLHAPTGSGKSTKVPVAYAALGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDIWDWICEVLSDFKTWLKAKLMPQLPGIPFVSCQRGYRGVWRGDGIMHTRCHCGAEITGHVKNGTMRIVGPRTCRNMWSGTFPINAYTTGPCTPLPAPNYKFALWRVSAEEYVEIRRVGDFHYVSGMTTDNLKCPCQIPSPEFFTELDGVRLHRFAPPCKPLLREEVSFRVGLHEYPVGSQLPCEPEPDVAVLTSMLTDPSHITAEAAGRRLARGSPPSMASSSASQLSAPSLKATCTANHDSPDAELIEANLLWRQEMGGNITRVESENKVVILDSFDPLVAEEDEREVSVPAEILRKSRRFARALPVWARPDYNPPLVETWKKPDYEPPVVHGCPLPPPRSPPVPPPRKKRTVVLTESTLSTALAELATKSFGSSSTSGITGDNTTTSSEPAPSGCPPDSDVESYSSMPPLEGEPGDPDLSDGSWSTVSSGADTEDVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 127 - protein, 3011 aa, Hepatitis C virus
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTGPASAYQVRNSTGLYHVTNDCPNSSIVFEAADAILHTPGCVPCVREGNASRCWVAVTPTVATRDGKLPTTQLRRHIDLLVGSATLCSALYVGDLCGSVFLVGQLFTFSPRRHWTTQDCNCSIYPGHISGHRMAWDMMMNWSPTAALLVAQLLRIPQAILDMIAGAHWGVLAGMAYFSMVGNWAKVLVVLLLFAGVDAETYVTGGSAARTTAGLASLFSPGAKQNIQLVNTNGSWHINSTALNCNDSLNTGWIAGLFYHHKFNSSGCSERLASCRPLTDFAQGWGPISHADGSGPDQRPYCWHYPPKPCGIVPAKSVCGPVYCFTPSPVVVGTTDRSGAPTYSWGANDTDVFVLNNTRPPLGNWFGCTWMNSTGFTKVCGAPPCVIGGVGNNTLRCPTDCFRKHPEATYSRCGSGPWITPRCLVDYPYRLWHYPCTINYTVFKVRMYVGGVEHRLEAACNWTRGDRCNLDDRDRSELSPLLLSTTQWQVLPCSFTTLPALSTGLIHLHQNIVDVQYLYGVGSSIASWAIKWEYVVLLFLLLADARVCSCLWMMLLISQVEAALENLVVLNAASLAGTHGLVSFLVFFCFAWYLKGKWVPGAVYALYGMWPLLLLLLALPQRAYALDTEVAASCGGVVLVGLMALTLSPYYKRYISWCLWWLQYFLTRIEAQLHVWIPPLNVRGGRDAVILLMCVVHPALVFDITKLLLAAFGPLWILQASLLKVPYFVRVQGLLRICALARKMAGGHYVQMAIIKLGALTGTYVYNHLTPLRDWAHNGLRDLAVAVEPVVFSRMETKLITWGADTAACGDIINGLPVSARRGREILLGPADGMVSKGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALWGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDIWDWICEVLSDFKTWLKAKLMPQLPGIPFVSCQRGYKGVWRGDGIMHTRCHCGAEITGHVKNGTMRIVGPKTCRNMWSGTFPINAYTTGPCTPLPAPNYTFALWRVSAEEYVEIRQVGDFHYVTGMTTDNLKCPCQVPSPEFFTELDGVRLHRFAPPCKPLLREEVSFRVGLHEYPVGSQLPCEPEPDVAVLTSMLTDPSHITAEAAGRRLARGSPPSMASSSASQLSAPSLRATCTTNHDSPDAELIEANLLWRQEMGGNITRVESENKVVILDSFDPLVAEEDEREVSVPAEILRKSRKFTPALPIWARPDYNPPLVEPWKKPDYEPPVVHGCPLPPPQSPPVPPPRKKRTVILTESTLPTALAELATKSFGSSSTSGITGDDTTTSPEPASSSCPPDSDAESYSSMPPLEGEPGDPDLSDGSWSTVSSEADKEDVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 128 - protein, 3010 aa, Hepatitis C virus
MSTNPKPQRKTKRNTNRRPQDVKFPGGGQIVGGVYLLPRRGPRLGVRATRKASERSQPRGRRQPIPKARRPEGRAWAQPGYPWPLYGNEGLGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTIPASAYEVRNVSGIYHVTNDCSNSSIVYEAADVIMHTPGCVPCVQEGNSSRCWVALTPTLAARNASVPTTTIRRHVDLLVGTAAFCSAMYVGDLCGSIFLVSQLFTFSPRRHETVQDCNCSIYPGHVSGHRMAWDMMMNWSPTTALVVSQLLRIPQAVVDMVAGAHWGVLAGLAYYSMVGNWAKVLIVALLFAGVDGETHTTGRVAGHTTSGFTSLFSSGASQKIQLVNTNGSWHINRTALNCNDSLQTGFFAALFYAHKFNSSGCPERMASCRPIDWFAQGWGPITYTKPNSSDQRPYCWHYAPRPCGVVPASQVCGPVYCFTPSPVVVGTTDRSGVPTYSWGENETDVMLLNNTRPPQGNWFGCTWMNSTGFTKTCGGPPCNIGGVGNRTLICPTDCFRKHPEATYTKCGSGPWLTPRCLVDYPYRLWHYPCTLNFSIFKVRMYVGGVEHRLNAACNWTRGERCNLEDRDRSELSPLLLSTTEWQILPCAFTTLPALSTGLIHLHQNIVDVQYLYGVGSAFVSFAIKWEYILLLFLLLADARVCACLWMMLLIAQAEAALENLVVLNAASVAGAHGILSFLVFFCAAWYIKGRLAPGAAYAFYGVWPLLLLLLALPPRAYALDREMAASCGGAVLVGLVFLTLSPYYKVFLTRLIWWLQYFITRAEAHMQVWVPPLNVRGGRDAIILLTCAVHPELILDITKLLLAILGPLMVLQAGITRVPYFVRAQGLIRACMLVRKVAGGHYVQMVFMKLGALTGTYVYNHLTPLRDWAHAGLRDLAVAVEPVVFSAMETKVITWGADTAACGDIILGLPVSARRGKEIFLGPADSLEGQGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRLGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWICTVLTDFKTWLQSKLLPRLPGVPFLSCQRGYKGVWRGDGIMQTTCPCGAQIAGHVKNGSMRIVGPRTCSNTWHGTFPINAYTTGPCTPSPAPNYSRALWRVAAEEYVEVTRVGDFHYVTGMTTDNVKCPCQVPAPEFFTEVDGVRLHRYAPACKPLLREDVTFQVGLNQYLVGSQLPCEPEPDVTVLTSMLTDPSHITAETAKRRLARGSPPSLASSSASQLSAPSLKATCTTHHDSPDADLIEANLLWRQEMGGNITRVESENKVVILDSFEPLHAEGDEREISVAAEILRKSRKFPSALPIWARPDYNPPLLESWKDPDYVPPVVHGCPLPPTKAPPIPPPRRKRTVVLTESNVSSALAELATKTFGSSGSSAVDSGTATALPDLASDDGDKGSDVESYSSMPPLEGEPGDPDLSDGSWSTVSEEASEDVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 129 - protein, 3010 aa, Hepatitis C virus
MSTNPKPQRKTKRNTNRRPQDVKFPGGGQIVGGVYLLPRRGPRLGVRATRKASERSQPRGRRQPIPKARRPEGRAWAQPGYPWPLYGNEGLGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTIPASAYEVRNVSGIYHVTNDCSNSSIVYEAADVIMHTPGCVPCVQEGNSSRCWVALTPTLAARNASVPTTTIRRHVDLLVGTAAFCSAMYVGDLCGSIFLVSQLFTFSPRRHETVQDCNCSIYPGHVSGHRMAWDMMMNWSPTTALVVSQLLRIPQAVVDMVAGAHWGVLAGLAYYSMVGNWAKVLIVALLFAGVDGETHTTGRVAGHTTSGFTSLFSSGASQKIQLVNTNGSWHINRTALNCNDSLQTGFFAALFYAHKFNSSGCPERMASCRPIDWFAQGWGPITYTKPNSSDQRPYCWHYAPRPCGVVPASQVCGPVYCFTPSPVVVGTTDRSGVPTYSWGENETDVMLLNNTRPPQGNWFGCTWMNSTGFTKTCGGPPCNIGGVGNRTLICPTDCFRKHPEATYTKCGSGPWLTPRCLVDYPYRLWHYPCTLNFSIFKVRMYVGGVEHRLNAACNWTRGERCNLEDRDRSELSPLLLSTTEWQILPCAFTTLPALSTGLIHLHQNIVDVQYLYGVGSAFVSFAIKWEYILLLFLLLADARVCACLWMMLLIAQAEAALENLVVLNAASVAGAHGILSFLVFFCAAWYIKGRLAPGAAYAFYGVWPLLLLLLALPPRAYALDREMAASCGGAVLVGLVFLTLSPYYKVFLTRLIWWLQYFITRAEAHMQVWVPPLNVRGGRDAIILLTCAVHPELILDITKLLLAILGPLMVLQAGITRVPYFVRAQGLIRACMLVRKVAGGHYVQMVFMKLGALTGTYVYNHLTPLRDWAHAGLRDLAVAVEPVVFSAMETKVITWGADTAACGDIILGLPVSARRGKEIFLGPADSLEGQGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVSSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRLGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWICTVLTDFKTWLQSKLLPRLPGVPFLSCQRGYKGVWRGDGIMQTTCPCGAQIAGHVKNGSMRIVGPRTCSNTWHGTFPINAYTTGPCTPSPAPNYSRALWRVAAEEYVEVTRVGDFHYVTGMTTDNVKCPCQVPAPEFFTEVDGVRLHRYAPACKPLLREDVTFQVGLNQYLVGSQLPCEPEPDVTVLTSMLTDPSHITAETAKRRLARGSPPSLASSSASQLSAPSLKATCTTHHDSPDADLIEANLLWRQEMGGNITRVESENKVVILDSFEPLHAEGDEREISVAAEILRKSRKFPSALPIWARPDYNPPLLESWKDPDYVPPVVHGCPLPPTKAPPIPPPRRKRTVVLTESNVSSALAELATKTFGSSGSSAVDSGTATALPDLASDDGDKGSDVESYSSMPPLEGEPGDPDLSDGSWSTVSEEASEDVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 130 - protein, 3021 aa, Hepatitis C virus
MSTLPKPQRKTKRNTIRRPQDVKFPGGGQIVGGVYVLPRRGPRLGVRATRKTSERSQPRGRRQPIPKARRSEGRSWAQPGYPWPLYGNEGCGWAGWLLSPRGSRPSWGPNDPRRRSRNLGKVIDTLTCGFADLMGYIPLVGAPVGGVARALAHGVRALEDGINFATGNLPGCSFSIFLLALFSCLVHPAASLEWRNTSGLYVLTNDCSNSSIVYEADDVILHTPGCVPCVQDDNTSTCWTPVTPTVAVRYVGATTASIRSHVDLLVGAATLCSALYVGDMCGAVFLVGQAFTFRPRRHQTVQTCNCSLYPGHVSGHRMAWDMMMNWSPAVGMVVAHILRLPQTLFDILAGAHWGILAGLAYYSMQGNWAKVAIVMIMFSGVDAETYVTGGSVAHSARGLTSLFSMGAKQKLQLVNTNGSWHINSTALNCNESINTGFIAGLFYYHKFNSTGCPQRLSSCKPIISFRQGWGPLTDANITGPSDDRPYCWHYAPRPCSVVPASSVCGPVYCFTPSPVVVGTTDIKGKPTYNWGENETDVFLLESLRPPSGRWFGCAWMNSTGFLKTCGAPPCNIYGGEGDPENETDLFCPTDCFRKHPEATYSRCGAGPWLTPRCMVDYPYRLWHYPCTVNFTLFKVRMFVGGFEHRFTAACNWTRGERCNIEDRDRSEQHPLLHSTTELAILPCSFTPMPALSTGLIHLHQNIVDVQYLYGVGSDMVGWALKWEFVILVFLLLADARVCVALWLMLMVSQAEAALENLVTLNAVAAAGTHGIGWYLVAFCAAWYVRGKLVPLTSYGLTGLWSLALLVLLLPQRAYAWSGEDSATLGAGVLALFGFFTLSPWYKHWIGRLMWWNQYTICRCEAALQVWVPPLLARGSRDGVILLTSLLYPSLIFDITKLLIAVIGPLYLIQAAITTTPYFVRAHVLVRLCMLVRSVMGGKYFQMAILSIGRWFNTYLYDHLAPMQHWAAAGLKDLAVATEPVIFSPMEIKVITWGADTAACGDILCGLPVSARLGREVLLGPADDYREMGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKQKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGDWLRDIWDWVCSVLSDFKTWLSAKIMPALPGLPFISCQKGYKGVWRGDGVMSTRCPCGASITGHVKNGSMRLAGPRMCANMWHGTFPINEYTTGPSTPCPSPNYTRALWRVAASSYVEVRRVGDFHYITGATEDELKCPCQVPAAEFFTEVDGVRLHRYAPPCKPLLREEITFSVGLHSYAIGSQLPCEPEPDVSVLTSMLRDPSHITAETAARRLARGSPPSEASSSASQLSAPSLKATCQTHRPHPDAELVDANLLWRQEMGSNITRVESETKVVILDSFEPLRAEADDAELSVAAECFKKPPKYPPALPIWARPDYNPPLLDRWKAPDYVPPTVHGCALPPRGAPPVPPPRRKRTIQLDGSNVSAALAALAEKSFPTPKSQEENSSSSGVDTQSSTTSRMPPSPGGESDSESCSSMPPLEGEPGDPDLSCDSWSTVSDNEEQSVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 131 - protein, 3021 aa, Hepatitis C virus
MSTLPKPQRKTKRNTIRRPQDVKFPGGGQIVGGVYVLPRRGPRLGVRATRKTSERSQPRGRRQPIPKARRSEGRSWAQPGYPWPLYGNEGCGWAGWLLSPRGSRPSWGPNDPRRRSRNLGKVIDTLTCGFADLMGYIPLVGAPVGGVARALAHGVRALEDGINFATGNLPGCSFSIFLLALFSCLVHPAASLEWRNTSGLYVLTNDCSNSSIVYEADDVILHTPGCVPCVQDDNTSTCWTPVTPTVAVRYVGATTASIRSHVDLLVGAATLCSALYVGDMCGAVFLVGQAFTFRPRRHQTVQTCNCSLYPGHVSGHRMAWDMMMNWSPAVGMVVAHILRLPQTLFDILAGAHWGILAGLAYYSMQGNWAKVAIVMIMFSGVDAETYVTGGSVAHSARGLTSLFSMGAKQKLQLVNTNGSWHINSTALNCNESINTGFIAGLFYYHKFNSTGCPQRLSSCKPIISFRQGWGPLTDANITGPSDDRPYCWHYAPRPCSVVPASSVCGPVYCFTPSPVVVGTTDIKGKPTYNWGENETDVFLLESLRPPSGRWFGCAWMNSTGFLKTCGAPPCNIYGGEGDPENETDLFCPTDCFRKHPEATYSRCGAGPWLTPRCMVDYPYRLWHYPCTVNFTLFKVRMFVGGFEHRFTAACNWTRGERCNIEDRDRSEQHPLLHSTTELAILPCSFTPMPALSTGLIHLHQNIVDVQYLYGVGSDMVGWALKWEFVILVFLLLADARVCVALWLMLMVSQAEAALENLVTLNAVAAAGTHGIGWYLVAFCAAWYVRGKLVPLTSYGLTGLWSLALLVLLLPQRAYAWSGEDSATLGAGVLALFGFFTLSPWYKHWIGRLMWWNQYTICRCEAALQVWVPPLLARGSRDGVILLTSLLYPSLIFDITKLLIAVIGPLYLIQAAITTTPYFVRAHVLVRLCMLVRSVMGGKYFQMAILSIGRWFNTYLYDHLAPMQHWAAAGLKDLAVATEPVIFSPMEIKVITWGADTAACGDILCGLPVSARLGREVLLGPADDYREMGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKQKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGDWLRDIWDWVCSVLSDFKTWLSAKIMPALPGLPFISCQKGYKGVWRGDGVMSTRCPCGASITGHVKNGSMRLAGPRMCANMWHGTFPINEYTTGPSTPCPSPNYTRALWRVAASSYVEVRRVGDFHYITGATEDELKCPCQVPAAEFFTEVDGVRLHRYAPPCKPLLREEITFSVGLHSYAIGSQLPCEPEPDVSVLTSMLRDPSHITAETAARRLARGSPPSEASSSASQLSAPSLKATCQTHRPHPDAELVDANLLWRQEMGSNITRVESETKVVILDSFEPLRAEADDAELSVAAECFKKPPKYPPALPIWARPDYNPPLLDRWKAPDYVPPTVHGCALPPRGAPPVPPPRRKRTIQLDGSNVSAALAALAEKSFPTPKSQEENSSSSGVDTQSSTTSRMPPSPGGESDSESCSSMPPLEGEPGDPDLSCDSWSTVSDNEEQSVVRCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 132 - protein, 3008 aa, Hepatitis C virus
MSTNPKPQRKTKRNTNRRPMDVKFPGGGQIVGGVYLLPRRGPRLGVRATRKTSERSQPRGRRQPIPKARRPEGRSWAQPGYPWPLYGNEGCGWAGWLLSPRGSRPSWGPNDPRRRSRNLGKVIDTLTCGFADLMGYIPLVGAPVGGVARALAHGVRALEDGINYATGNLPGCSFSIFLLALLSCLTVPASAVNYRNVSGIYHVTNDCPNSSIVYEADHHILHLPGCVPCVREGNQSRCWVALTPTVAAPYIGAPLESLRSHVDLMVGAATVCSGLYIGDLCGGLFLVGQMFSFRPRRHWTTQDCNCSIYTGHITGHRMAWDMMMNWSPTTTLVLAQVMRIPTTLVDLLSGGHWGVLVGVAYFSMQANWAKVILVLFLFAGVDAETHVSGAAVGRSTAGLANLFSSGSKQNLQLINSNGSWHINRTALNCNDSLNTGFLASLFYTHKFNSSGCSERLACCKSLDSYGQGWGPLGVANISGSSDDRPYCWHYAPRPCGIVPASSVCGPVYCFTPSPVVVGTTDHVGVPTYTWGENETDVFLLNSTRPPHGAWFGCVWMNSTGFTKTCGAPPCEVNTNNGTWHCPTDCFRKHPETTYAKCGSGPWITPRCLIDYPYRLWHFPCTANFSVFNIRTFVGGIEHRMQAACNWTRGEVCGLEHRDRVELSPLLLTTTAWQILPCSFTTLPALSTGLIHLHQNIVDVQYLYGVGSAVVSWALKWEYVVLAFLLLADARVSACLWMMFMVSQVEAALSNLININAASAAGAQGFWYAILFICIVWHVKGRFPAAAAYAACGLWPLFLLLLMLPERAYAYDQEVAGSLGGAIVVMLTILTLSPHYKLWLARGLWWIQYFIARTEAVLHVYIPSFNVRGPRDSVIVLAVLVCPHLVFDITKYLLAILGPLHILQASLLRIPYFVRAQALVKICSLLRGVVYGKYFQMVVLKAGALTGTYIYDHLTPMSDWAATGLRDLAVALEPVVFTPMEKKVIVWGADTAACGDIIRGLPVSARLGNEILLGPADTETSKGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCAESWLWEVWDWVCTVLSDFKTWLKAKLLPLMPGIPFLSCQRGYKGEWRGDGVMHTTCPCGADLAGHIKNGSMRITGPKTCSNTWHGTFPINAYTTGPGVPIPAPNYKFALWRVSAEDYVEVRRVGDFHYVTGVTQDNIKCPCQVPAPEFFTEVDGIRLHRHAPKCKPLLRDEVSFSVGLNSFVVGSQLPCEPEPDVAVLTSMLTDPSHITAESARRRLARGSRPSLASSSASQLSAPSLKATCTAPHDSPGTDLLEANLLWGSTATRVETDEKVIILDSFESCVAEPNDDREVSVAAEILRPTKKFPPALPIWARPDYNPPLTETWKQQDYKPPTVHGCALPPGKQPPVPPPRRKRTVQLTESVVSTALAELAAKTFGQSEPSSDRDTDLTTPTETTDSGPIVVDDASDDGSYSSMPPLEGEPGDPDLTSDSWSTVSGSEDVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 133 - protein, 3008 aa, Hepatitis C virus
MSTNPKPQRKTKRNTNRRPMDVKFPGGGQIVGGVYLLPRRGPRLGVRATRKTSERSQPRGRRQPIPKARRPEGRSWAQPGYPWPLYGNEGCGWAGWLLSPRGSRPSWGPNDPRRRSRNLGKVIDTLTCGFADLMGYIPLVGAPVGGVARALAHGVRALEDGINYATGNLPGCSFSIFLLALLSCLTVPASAVNYRNVSGIYHVTNDCPNSSIVYEADHHILHLPGCVPCVREGNQSRCWVALTPTVAAPYIGAPLESLRSHVDLMVGAATVCSGLYIGDLCGGLFLVGQMFSFRPRRHWTTQDCNCSIYTGHITGHRMAWDMMMNWSPTTTLVLAQVMRIPTTLVDLLSGGHWGVLVGVAYFSMQANWAKVILVLFLFAGVDAETHVSGAAVGRSTAGLANLFSSGSKQNLQLINSNGSWHINRTALNCNDSLNTGFLASLFYTHKFNSSGCSERLACCKSLDSYGQGWGPLGVANISGSSDDRPYCWHYAPRPCGIVPASSVCGPVYCFTPSPVVVGTTDHVGVPTYTWGENETDVFLLNSTRPPHGAWFGCVWMNSTGFTKTCGAPPCEVNTNNGTWHCPTDCFRKHPETTYAKCGSGPWITPRCLIDYPYRLWHFPCTANFSVFNIRTFVGGIEHRMQAACNWTRGEVCGLEHRDRVELSPLLLTTTAWQILPCSFTTLPALSTGLIHLHQNIVDVQYLYGVGSAVVSWALKWEYVVLAFLLLADARVSACLWMMFMVSQVEAALSNLININAASAAGAQGFWYAILFICIVWHVKGRFPAAAAYAACGLWPLFLLLLMLPERAYAYDQEVAGSLGGAIVVMLAILTLSPHYKLWLARGLWWIQYFIARTEAVLHVYIPSFNVRGPRDSVIVLAVLVCPHLVFDITKYLLAILGPLHILQASLLRIPYFVRAQALVKICSLLRGVVYGKYFQMVVLKAGALTGTYIYDHLTPMSDWAATGLRDLAVALEPVVFSPMEKKVIVWGADTAACGDIIRGLPVSARLGNEILLGPADTETSKGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCAESWLWEVWDWVCTVLSDFKTWLKAKLLPLMPGIPFLSCQRGYKGEWRGDGVMHTTCPCGADLAGHIKNGSMRITGPKTCSNTWHGTFPINAYTTGPGVPIPAPNYKFALWRVSAEDYVEVRRVGDFHYVTGVTQDNIKCPCQVPAPEFFTEVDGIRLHRHAPKCKPLLRDEVSFSVGLNSFVVGSQLPCEPEPDVAVLTSMLTDPSHITAESARRRLARGSRPSLASSSASQLSAPSLKATCTAPHDSPGTDLLEANLLWGSTATRVETDEKVIILDSFESCVAEPNDDREVSVAAEILRPTKKFPPALPIWARPDYNPPLTETWKQQDYKPPTVHGCALPPGKQPPVPPPRRKRTVQLTESVVSTALAELAAKTFGQSEPSSDRDTDLTTPTETTDSGPIVVDDASDDGSYSSMPPLEGEPGDPDLTSDSWSTVSGSEDVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 134 - protein, 3014 aa, Hepatitis C virus
MSTNPKPQRKTKRNTNRRPQDVKFPGGGQIVGGVYLLPRRGPRLGVRATRKTSERSQPRGRRQPIPKARQPTGRSWGQPGYPWPLYANEGLGWAGWLLSPRGSRPNWGPNDPRRKSRNLGKVIDTLTCGFADLMGYIPLVGGPVGGVARALAHGVRVLEDGVNYATGNLPGCSFSIFILALLSCLTVPTSAVPYRNASGVYHVTNDCPNSSIVYEAEDLILHAPGCVPCVRQGNVSRCWVQITPTLSAPSLGAVTAPLRRAVDYLAGGAALCSALYVGDACGAVFLVGQMFTYSPRRHNVVQDCNCSIYSGHITGHRMAWDMMMNWSPTTALVMAQLLRIPQVVIDIIAGAHWGVLFAAAYYASAANWAKVVLVLFLFAGVDASTRTVGGSAAQGARGLASLFTPGPQQNLQLINTNGSWHINRTALNCNDSLQTGFVAGLLYYHKFNSTGCPQRMASCRPLAAFDQGWGTISYAAVSGPSDDKPYCWHYPPRPCGIVPARGVCGPVYCFTPSPVVVGTTDRKGNPTYSWGENETDIFLLNNTRPPTGNWFGCTWMNSTGFVKTCGAPPCNLGPTGNNSLKCPTDCFRKHPDATYTKCGSGPWLTPRCLVHYPYRLWHYPCTLNYTIFKVRMYIGGLEHRLEVACNWTRGERCDLEDRDRAELSPLLHTTTQWAILPCSFTPTPALSTGLIHLHQNIVDTQYLYGLSSSIVSWAVKWEYIVLAFLLLADARICTCLWIMLLVCQAEAALENVIVLNAAAAAGTHGFFWGLLVICFAWHFKGRLVPGATYLCLGIWPLLLLLFLLPQRALALDSSDGGTVGCLVLTILTIFTLTPGYKKMVVLVIWWLQYFIARVEAFIHVWVPPLQVRGGRDAIIMLTCLFHPALGFEVTKILLGILGPLYLLQYSLIKLPYFIRARALLRACLLAKHLACGRYVQAALLHLGRLTGTYIYDHLAPMKDWAASGLRDLAVATEPIIFSPMETKVITWGADTAACGDILAGLPVSARRGHEIFLGPADDIREAGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCDGTWLRAIWDWVCTALTDFKAWLQAKLLPQLPGVPFLSCQRGYKGVWRGDGVNSTKCPCGATISGHVKNGTMRIVGPKLCSNTWHGTFPINATTTGPSVPAPAPNYKFALWRVGAADYAEVRRVGDYHYITGVTQDNLKCPCQVPSPEFFTELDGVRIHRYAPPCNPLLREEVCFSVGLHSFVVGSQLPCEPEPDVTVLTSMLSDPAHITAETAKRRLDRGSPPSLASSSASQLSAPSLKATCTTQGHHPDADLIEANLLWRQCMGGNITRVEAENKVVILDSFEPLKADDDDREISVSADCFRRGPAFPPALPVWARPGYDPPLLETWKQPDYDPPQVSGCPLPPAGLPPVPPPRRKRKPVVLSDSNVSQVLADLAHARFKADTQSIEGQDSAVGTSSQPDSGPEEKRDDDSDAASYSSMPPLEGEPGDPDLSSGSWSTVSDEDSVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 135 - protein, 3014 aa, Hepatitis C virus
MSTNPKPQRKTKRNTNRRPQDVKFPGGGQIVGGVYLLPRRGPRLGVRATRKTSERSQPRGRRQPIPKARQPTGRSWGQPGYPWPLYANEGLGWAGWLLSPRGSRPNWGPNDPRRKSRNLGKVIDTLTCGFADLMGYIPLVGGPVGGVARALAHGVRVLEDGVNYATGNLPGCSFSIFILALLSCLTVPTSAVPYRNASGVYHVTNDCPNSSIVYEAEDLILHAPGCVPCVRQGNVSRCWVQITPTLSAPSLGAVTAPLRRAVDYLAGGAALCSALYVGDACGAVFLVGQMFTYSPRRHNVVQDCNCSIYSGHITGHRMAWDMMMNWSPTTALVMAQLLRIPQVVIDIIAGAHWGVLFAAAYYASAANWAKVVLVLFLFAGVDASTRTVGGSAAQGARGLASLFTPGPQQNLQLINTNGSWHINRTALNCNDSLQTGFVAGLLYYHKFNSTGCPQRMASCRPLAAFDQGWGTISYAAVSGPSDDKPYCWHYPPRPCGIVPARGVCGPVYCFTPSPVVVGTTDRKGNPTYSWGENETDIFLLNNTRPPTGNWFGCTWMNSTGFVKTCGAPPCNLGPTGNNSLKCPTDCFRKHPDATYTKCGSGPWLTPRCLVHYPYRLWHYPCTLNYTIFKVRMYIGGLEHRLEVACNWTRGERCDLEDRDRAELSPLLHTTTQWAILPCSFTPTPALSTGLIHLHQNIVDTQYLYGLSSSIVSWAVKWEYIVLAFLLLADARICTCLWIMLLVCQAEAALENVIVLNAAAAAGTHGFFWGLLVICFAWHFKGRLVPGATYLCLGIWPLLLLLFLLPQRALALDSSDGGTVGCLVLTILTIFTLTPGYKKMVVLVIWWLQYFIARVEAFIHVWVPPLQVRGGRDAIIMLTCLFHPALGFEVTKILLGILGPLYLLQYSLIKLPYFIRARALLRACLLAKHLACGRYVQAALLHLGRLTGTYIYDHLAPMKDWAASGLRDLAVATEPIIFSPMETKVITWGADTAACGDILAGLPVSARRGHEIFLGPADDIREGGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTRSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCDGTWLRAIWDWVCTALTDFKAWLQAKLLPQLPGVPFLSCQRGYKGVWRGDGVNSTKCPCGATISGHVKNGTMRIVGPKLCSNTWHGTFPINATTTGPSVPAPAPNYKFALWRVGAADYAEVRRVGDYHYITGVTQDNLKCPCQVPSPEFFTELDGVRIHRYAPPCNPLLREEVCFSVGLHSFVVGSQLPCEPEPDVTVLTSMLSDPAHITAETAKRRLDRGSPPSLASSSASQLSAPSLKATCTTQGHHPDADLIEANLLWRQCMGGNITRVEAENKVVILDSFEPLKADDDDREISVSADCFRRGPAFPPALPVWARPGYDPPLLETWKQPDYDPPQVSGCPLPPAGLPPVPPPRRKRKPVVLSDSNVSQVLADLAHARFKADTQSIEGQDSAVGTSSQPDSGPEEKRDDDSDAASYSSMPPLEGEPGDPDLSSGSWSTVSDEDSVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 136 - protein, 3014 aa, Hepatitis C virus
MSTNPKPQRKTKRNTNRRPQDVKFPGGGQIVGGVYLLPRRGPRLGVRATRKTSERSQPRGRRQPIPKARQPTGRSWGQPGYPWPLYANEGLGWAGWLLSPRGSRPNWGPNDPRRKSRNLGKVIDTLTCGFADLMGYIPLVGGPVGGVARALAHGVRVLEDGVNYATGNLPGCSFSIFILALLSCLTVPTSAVPYRNASGVYHVTNDCPNSSIVYEAEDLILHAPGCVPCVRQGNVSRCWVQITPTLSAPSLGAVTAPLRRAVDYLAGGAALCSALYVGDACGAVFLVGQMFTYSPRRHNVVQDCNCSIYSGHITGHRMAWDMMMNWSPTTALVMAQLLRIPQVVIDIIAGAHWGVLFAAAYYASAANWAKVVLVLFLFAGVDASTRTVGGSAAQGARGLASLFTPGPQQNLQLINTNGSWHINRTALNCNDSLQTGFVAGLLYYHKFNSTGCPQRMASCRPLAAFDQGWGTISYAAVSGPSDDKPYCWHYPPRPCGIVPARGVCGPVYCFTPSPVVVGTTDRKGNPTYSWGENETDIFLLNNTRPPTGNWFGCTWMNSTGFVKTCGAPPCNLGPTGNNSLKCPTDCFRKHPDATYTKCGSGPWLTPRCLVHYPYRLWHYPCTLNYTIFKVRMYIGGLEHRLEVACNWTRGERCDLEDRDRAELSPLLHTTTQWAILPCSFTPTPALSTGLIHLHQNIVDTQYLYGLSSSIVSWAVKWEYIVLAFLLLADARICTCLWIMLLVCQAEAALENVIVLNAAAAAGTHGFFWGLLVICFAWHFKGRLVPGATYLCLGIWPLLLLLFLLPQRALALDSSDGGTVGCLVLTILTIFTLTPGYKKMVVLVIWWLQYFIARVEAFIHVWVPPLQVRGGRDAIIMLTCLFHPALGFEVTKILLGILGPLYLLQYSLIKLPYFIRARALLRACLLAKHLACGRYVQAALLHLGRLTGTYIYDHLAPMKDWAASGLRDLAVATEPIIFSPMETKVITWGADTAACGDILAGLPVSARRGHEIFLGPADDIREGGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTRSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCDGTWLGAIWDWVCTALTDFKAWLQAKLLPQLPGVPFLSCQRGYKGVWRGDGVNSTKCPCGATISGHVKNGTMRIVGPKLCSNTWHGTFPINATTTGPSVPAPAPNYKFALWRVGAADYAEVRRVGDYHYITGVTQDNLKCPCQVPSPEFFTELDGVRIHRYAPPCNPLLREEVCFSVGLHSFVVGSQLPCEPEPDVTVLTSMLSDPAHITAETAKRRLDRGSPPSLASSSASQLSAPSLKATCTTQGHHPDADLIEANLLWRQCMGGNITRVEAENKVVILDSFEPLKADDDDREISVSADCFRRGPAFPPALPVWARPGYDPPLLETWKQPDYDPPQVSGCPLPPAGLPPVPPPRRKRKPVVLSDSNVSQVLADLAHARFKADTQSIEGQDSAVGTSSQPDSGPEEKRDDDSDAASYSSMPPLEGEPGDPDLSSGSWSTVSDEDSVVRCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 137 - protein, 3020 aa, Hepatitis C virus
MSTLPKPQRKTKRNTNRRPMDVKFPGGGQIVGGVYLLPRRGPRLGVRATRKTSERSQPRGRRQPIPKARQPQGRHWAQPGYPWPLYGNEGCGWAGWLLSPRGSRPHWGPNDPRRRSRNLGKVIDTLTCGFADLMGYIPVVGAPLGGVAAALAHGVRAIEDGINYATGNLPGCSFSIFLLALLSCLTTPASALTYGNSSGLYHLTNDCPNSSIVLEADAMILHLPGCLPCVRVNNNQSICWHAVSPTLAIPNASTPATGFRRHVDLLAGAAVVCSSLYIGDLCGSLFLAGQLFTFQPRRHWTVQDCNCSIYTGHVTGHRMAWDMMMNWSPTTTLVLSSILRVPEICASVISGGHWGILLAVAYFGMAGNWLKVLAVLFLFAGVEATTTIGHQVGRTTGGLASLFSIGPRQNLQLINTTGSWHINRTALNCNDSLQTGFITSLFYAKNVNSSGCPERMAACKPLADFRQGWGQITYKVNISGPSDDRPYCWHYAPRPCDVVSARTVCGPVYCFTPSPVVVGTTDKLGIPTYNWGENETDVFMLESLRPPTGGWFGCTWMNSTGFTKTCGAPPCQIVPGDYNSSANELLCPTDCFRKHPEATYQRCGSGPWITPRCLVDYPYRLWHYPCTVNFTLHKVRMFVGGIEHRFDAACNWTRGERCDLHDRDRIEMSPLLFSTTQLAILPCSFSTMPALSTGLIHLHQNIVDVQYLYGVSSSVTSWVVKWEYIVLVFLVLADARICTCLWLMLLITNVEAAVERLVVLNAASAAGTAGWWWAVLFLCCAWYVKGRLVPACTYMALGMWPLLLTILALPRRAYAMDNEQAASLGAVGLLVLTIFTITPMYKKLLTCSIWWNQYFLARAEAMIHEWVPDLRVRGGRDSIILLTCLLHPQLGFEVTKILLAILAPLYILQYSLLKVPYFVRAHVLLRACLLVRRLAGGKYVQACLLRLGAWTGTFVYDHLAPLSDWASDGLRDLAVAIEPVIFSPMEKKIITWGADTAACGDILSGLPVSARLGNLVLLGPADDMQRGGWKLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCATSWLRDVWDWVCTVLSDFRVWLKAKLLPRLPGIPFLSCQTGYRGVWAGDGVCHTTCTCGAVIAGHVKNGTMKITGPKTCSNTWHGTFPINATTTGPSTPRPAPNYQRALWRVSAEDYVEVRRLGDCHYVVGVTAEGLKCPCQVPAPEFFTEVDGVRIHRYAPPCKPLLRDEVTFSVGLSSYAIGSQLPCEPEPDVTVVTSMLTDPTHITAETAARRLKRGSPPSLASSSASQLSAPSLKATCTTSKDHPDMELIEANLLWRQEMGGNITRVESENKVVILDSFEPLTAEYDEREISVSAECHRPPRRKFPPALPIWARPDYNPPLIQAWQMPGYEPPVVSGCAVAPPKPAPIPPPRRKRLVHLDESTVSHALAQLADKVFVESSSDPGPSSDSGLSIASPVPPAPTTPDDACSEAGSYSSMPPLEGEPGDPDLSSGSWSTVSDQDDVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 138 - protein, 3020 aa, Hepatitis C virus
MSTLPKPQRKTKRNTNRRPMDVKFPGGGQIVGGVYLLPRRGPRLGVRATRKTSERSQPRGRRQPIPKARQPQGRHWAQPGYPWPLYGNEGCGWAGWLLSPRGSRPHWGPNDPRRRSRNLGKVIDTLTCGFADLMGYIPVVGAPLGGVAAALAHGVRAIEDGINYATGNLPGCSFSIFLLALLSCLTTPASALTYGNSSGLYHLTNDCPNSSIVLEADAMILHLPGCLPCVRVNNNQSICWHAVSPTLAIPNASTPATGFRRHVDLLAGAAVVCSSLYIGDLCGSLFLAGQLFTFQPRRHWTVQDCNCSIYTGHVTGHRMAWDMMMNWSPTTTLVLSSILRVPEICASVISGGHWGILLAVAYFGMAGNWLKVLAVLFLFAGVEATTTIGHQVGRTTGGLASLFSIGPRQNLQLINTTGSWHINRTALNCNDSLQTGFITSLFYAKNVNSSGCPERMAACKPLADFRQGWGQITYKVNISGPSDDRPYCWHYAPRPCDVVSARTVCGPVYCFTPSPVVVGTTDKLGIPTYNWGENETDVFMLESLRPPTGGWFGCTWMNSTGFTKTCGAPPCQIVPGDYNSSANELLCPTDCFRKHPEATYQRCGSGPWITPRCLVDYPYRLWHYPCTVNFTLHKVRMFVGGIEHRFDAACNWTRGERCDLHDRDRIEMSPLLFSTTQLAILPCSFSTMPALSTGLIHLHQNIVDVQYLYGVSSSVTSWVVKWEYIVLVFLVLADARICTCLWLMLLITNVEAAVERLVVLNAASAAGTAGWWWAVLFLCCAWYVKGRLVPACTYMALGMWPLLLTILALPRRAYAMDNEQAASLGAVGLLVLTIFTITPMYKKLLTCSIWWNQYFLARAEAMIHEWVPDLRVRGGRDSIILLTCLLHPQLGFEVTKILLAILAPLYILQYSLLKVPYFVRAHVLLRACLLVRRLAGGKYVQACLLRLGAWTGTFVYDHLAPLSDWASDGLRDLAVAIEPVIFSPMEKKIITWGADTAACGDILSGLPVSARLGNLVLLGPADDMQRGGWKLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCATSWLRDVWDWVCTVLSDFRVWLKAKLLPRLPGIPFLSCQTGYRGVWAGDGVCHTTCTCGAVIAGHVKNGTMKITGPKTCSNTWHGTFPINATTTGPSTPRPAPNYQRALWRVSAEDYVEVRRLGDCHYVVGVTAEGLKCPCQVPAPEFFTEVDGVRIHRYAPPCKPLLRDEVTFSVGLSSYAIGSQLPCEPEPDVTVVTSMLTDPTHITAETAARRLKRGSPPSLASSSASQLSAPSLKATCTTSKDHPDMELIEANLLWRQEMGGNITRVESENKVVILDSFEPLTAEYDERENSVSAECHRPPRRKFPPALPIWARPDYNPPLIQAWQMPGYEPPVVSGCAVAPPKPAPIPPPRRKRLVHLDESTVSHALAQLADKVFVESSSDPGPSSDSGLSIASPVPPAPTTPDDACSEAGSYSSMPPLEGEPGDPDLSSGSWSTVSDQDDVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 139 - protein, 3013 aa, Hepatitis C virus
MSTNPKPQRLTKRNTVRRPQNVKFPGGGQIVGGVYLLPRRGPRLGVRGTRKSSERSQPRGRRQRIPKAASSQGKAWGKPGYPWPLYGNEGCGWAGWLLSPRGSRPTWGPTDPRHRSRNLGKVIDTMTCGFADLMGYIPVLGAPLGGVARALAHGVRVLEDGVNYATGNLPGCSFSIFLLALLSCLTVPASAYEVRNSSGVYHLTNDCPNASIVYETDNAILHEPGCVPCVREGNTSRCWEPVAPTLAVRYRGALTDDLRTHIDLVVASATLCSALYVGDICGAIFIASQAVLWKPGGGRIVQDCNCSIYPGHVTGHRMAWDMMQNWAPALSMVAAYAVRVPGVIITTVAGGHWGVLFGLAYFGMAGNWAKVILIMLLMSGVDAETMAVGARAAHTTGALVSLLNPGPSQRLQLINTNGSWHINRTALNCNDSLQTGFIAALFYTHRFNSSGCPERMASCKPLSDFDQGWGPLWYNSTERPSDQRPYCWHYAPSPCGIVPAKDVCGPVYCFTPSPVVVGTTDRRGVPTYTWGENESDVFLLNSTRPPQGSWFGCSWMNTTGFTKTCGGPPCKIRPQGAQSNTSLTCPTDCFRKHPRATYSACGSGPWLTPRCMVHYPYRLWHYPCTVNFTIHKVRLYIGGVEHRLDAACNWTRGERCDLEDRDRVDMSPLLHSTTELAILPCSFVPLPALSTGLIHLHQNIVDAQYLYGLSPAIISWAIRWEWVVLVFLLLADARICACLWMMMLMAQAEAALENLIHLNAASLAGTHGIWWLLLVFCASWHLRGRVVPLVTYGICGMWPFFLMLLSLPPRAYALDREVSAALGTGMLAIILLVTLGPHYKRLLALILWWVTYFLTRCEAALQTWVPPLNPRGGRDGFILCVPLCYPGLVFDITKWLLVMMCPLYLLQLCLVRTPYFVRAQALIRVCSLFKTLAGGRYVQAALLTIGRWTGTYIYNHLAPLETWAAGGLRDLAVAVEPVIFSPMEKKIIVWGAETTACGDILCGLPVSARLGREVLLGPADDYRSMGWQLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCAGSWLREVWDWVCMVLSDFASWLKAKVLPSLPGIPFLSCQKGYKGEWRNDGIMNTKCPCGALIAGHVKNGSMRIVGPKTCRNTWWGTFPINSHTTGPSSPVPSHCYQRALWRVSATEYVEILRHNDQHYVVGVTAEDLKCPCQVPSPEFFSFVDGVRIHRFAPEPKPMIREEAAFVVGLHSYVVGSQLPCEPEPDVQTVSQLLTDPSHITAETAARRLRRGSPPSNASSSASQLSAPSLKATHTTLPQHPDAELIEANLMWEHKVGAIRRMETDTKVIILDSFDSASSVEDDMEPSTAAECLRTRKVFPPAMPIWARPDYNPPVVENWKDPEYAPPQVSGCALPPAQTPPVPPPRRKRAVIQLTESAVSTALAELAERSFPKEEAPPSDSAISLDSPAANDPPSDCDQGSEISFSSMPPLEGEPGDPDLSDGSWSTVSTRSDVICCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 140 - protein, 3015 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDIWDWICEVLSDFKTWLKAKLMPQLPGIPFVSCQRGYRGVWRGDGIMHTRCHCGAEITGHVKNGTMRIVGPRTCRNMWSGTFPINAHTTGPCTPLPAPNYKFALWRVSAEEYVEIRRVGDFHYVSGMTTDNLKCPCQIPSPEFFTELDGVRLHRFAPPCKPLLREEVSFRVGLHEYPVGSQLPCEPEPDVAVLTSMLTDPSHITAEAAGRRLARGSPPSMASSSASQLSAPSLKATCTANHDSPDAELIEANLLWRQEMGGNITRVESENKVVILDSFDPLVAEEDEREVSVPAEILRKSRRFARALPVWARPDYNPPLVETWKKPDYEPPVVHGCPLPPPRSPPVPPPRKKRTVVLTESTLSTALAELATKSFGSSSTSGITGDNTTTSSEPAPSGCPPDSDVESYSSMPPLEGEPGDPDLSDGSWSTVSSGADTEDVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 141 - protein, 3014 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVHGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVSSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWICTVLTDFKTWLQSKLLPRLPGVPFLSCQRGYKGVWRGDGIMQTTCPCGAQIAGHVKNGSMRIVGPRTCSNTWHGTFPINAHTTGPCTPSPAPNYSRALWRVAAEEYVEVTRVGDFHYVTGMTTDNVKCPCQVPAPEFFTEVDGVRLHRYAPACKPLLREDVTFQVGLNQYLVGSQLPCEPEPDVTVLTSMLTDPSHITAETAKRRLARGSPPSLASSSASQLSAPSLKATCTTHHDSPDADLIEANLLWRQEMGGNITRVESENKVVILDSFEPLHAEGDEREISVAAEILRKSRKFPSALPIWARPDYNPPLLESWKDPDYVPPVVHGCPLPPTKAPPIPPPRRKRTVVLTESNVSSALAELATKTFGSSGSSAVDSGTATALPDLASDDGDKGSDVESYSSMPPLEGEPGDPDLSDGSWSTVSEEASEDVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 142 - protein, 3033 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCHTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTYDVDMVDANLLMEGGVAQTEPESRVPVLDFLEPMAEEESDLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 143 - protein, 3019 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGGWLRDIWDWVCSVLSDFKTWLSAKIMPALPGLPFISCQKGYKGVWRGDGVMSTRCPCGASITGHVKNGSMRLAGPRMCANMWHGTFPINEHTTGPSTPCPSPNYTRALWRVAASSYVEVRRVGDFHYITGATEDELKCPCQVPAAEFFTEVDGVRLHRYAPPCKPLLREEITFSVGLHSYAIGSQLPCEPEPDVSVLTSMLRDPSHITAETAARRLARGSPPSEASSSASQLSAPSLKATCQTHRPHPDAELVDANLLWRQEMGSNITRVESETKVVILDSFEPLRAEADDAELSVAAECFKKPPKYPPALPIWARPDYNPPLLDRWKAPDYVPPTVHGCALPPRGAPPVPPPRRKRTIQLDGSNVSAALAALAEKSFPTPKSQEENSSSSGVDTQSSTTSRMPPSPGGESDSESCSSMPPLEGEPGDPDLSCDSWSTVSDNEEQSVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 144 - protein, 3012 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFSVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKHIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCAESWLWEVWDWVCTVLSDFKTWLKAKLLPLMPGIPFLSCQRGYKGEWRGDGVMHTTCPCGADLAGHIKNGSMRITGPKTCSNTWHGTFPINAHTTGPGVPIPAPNYKFALWRVSAEDYVEVRRVGDFHYVTGVTQDNIKCPCQVPAPEFFTEVDGIRLHRHAPKCKPLLRDEVSFSVGLNSFVVGSQLPCEPEPDVAVLTSMLTDPSHITAESARRRLARGSRPSLASSSASQLSAPSLKATCTAPHDSPGTDLLEANLLWGSTATRVETDEKVIILDSFESCVAEPNDDRGVSVAAEILRPTKKFPPALPIWARPDYNPPLTETWKQQDYKPPTVHGCALPPGKQPPVPPPRRKRTVQLTESVVSTALAELAAKTFGQSEPSSDRDTDLTTPTETTDSGPIVVDDASDDGSYSSMPPLEGEPGDPDLTSDSWSTVSGSEDVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 145 - protein, 3017 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCDGTWLGAIWDWVCTALTDFKAWLQAKLLPQLPGVPFLSCQRGYKGVWRGDGVNSTKCPCGATISGHVKNGTMRIVGPKLCSNTWHGTFPINAHTTGPSVPAPAPNYKFALWRVGAADYAEVRRVGDYHYITGVTQDNLKCPCQVPSPEFFTELDGVRIHRYAPPCNPLLREEVCFSVGLHSFVVGSQLPCEPEPDVTVLTSMLSDPAHITAETAKRRLDRGSPPSLASSSASQLSAPSLKATCTTQGHHPDADLIEANLLWRQCMGGNITRVEAENKVVILDSFEPLKADDDDREISVSADCFRRGPAFPPALPVWARPGYDPPLLETWKQPDYDPPQVSGCPLPPAGLPPVPPPRRKRKPVVLSDSNVSQVLADLAHARFKADTQSIEGQDSAVGTSSQPDSGPEEKRDDDSDAASYSSMPPLEGEPGDPDLSSGSWSTVSDEDGVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 146 - protein, 3018 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCATSWLRDVWDWVCTVLSDFRVWLKAKLLPRLPGIPFLSCQTGYRGVWAGDGVCHTTCTCGAVIAGHVKNGTMKITGPKTCSNTWHGTFPINAHTTGPSTPRPAPNYQRALWRVSAEDYVEVRRLGDCHYVVGVTAEGLKCPCQVPAPEFFTEVDGVRIHRYAPPCKPLLRDEVTFSVGLSSYAIGSQLPCEPEPDVTVVTSMLTDPTHITAETAARRLKRGSPPSLASSSASQLSAPSLKATCTTSKDHPDMELIEANLLWRQEMGGNITRVESENKVVILDSFEPLTAEYDERENSVSAECHRPPRRKFPPALPIWARPDYNPPLIQAWQMPGYEPPVVSGCAVAPPKPAPIPPPRRKRLVHLDESTVSHALAQLADKVFVESSSDPGPSSDSGLSIASPVPPAPTTPDDACSEAGSYSSMPPLEGEPGDPDLSSGSWSTVSDQDDVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 147 - protein, 2971 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDIWDWICEVLSDFKTWLKAKLMPQLPGIPFVSCQRGYRGVWRGDGIMHTRCHCGAEITGHVKNGTMRIVGPRTCRNMWSGTFPINAYTTGPCTPLPAPNYKFALWRVSAEEYVEIRRVGDFHYVSGMTTDNLKCPCQIPSPEFFTELDGVRLHRFAPPCKPLLREEVSFRVGLHEYPVGSQLPCEPEPDVAVLTSMLTDPSHITAEAAGRRLARGSPPSMASSSASQLSAPSLKATCTANHDSREVSVPAEILRKSRRFARALPVWARPDYNPPLVETWKKPDYEPPVVHGCPLPPPRSPPVPPPRKKRTVVLTESTLSTALAELATKSFGSSSTSGITGDNTTTSSEPAPSGCPPDSDVESYSSMPPLEGEPGDPDLSDGSWSTVSSGADTEDVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 148 - protein, 2971 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDIWDWICEVLSDFKTWLKAKLMPQLPGIPFVSCQRGYKGVWRGDGIMHTRCHCGAEITGHVKNGTMRIVGPKTCRNMWSGTFPINAYTTGPCTPLPAPNYTFALWRVSAEEYVEIRQVGDFHYVTGMTTDNLKCPCQVPSPEFFTELDGVRLHRFAPPCKPLLREEVSFRVGLHEYPVGSQLPCEPEPDVAVLTSMLTDPSHITAEAAGRRLARGSPPSMASSSASQLSAPSLRATCTTNHDSREVSVPAEILRKSRKFTPALPIWARPDYNPPLVEPWKKPDYEPPVVHGCPLPPPQSPPVPPPRKKRTVILTESTLPTALAELATKSFGSSSTSGITGDDTTTSPEPASSSCPPDSDAESYSSMPPLEGEPGDPDLSDGSWSTVSSEADKEDVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 149 - protein, 2993 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 150 - protein, 3000 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDIWDWICEVLSDFKTWLKAKLMPQLPGIPFVSCQRGYRGVWRGDGIMHTRCHCGAEITGHVKNGTMRIVGPRTCRNMWSGTFPINAYTTGPCTPLPAPNYKFALWRVSAEEYVEIRRVGDFHYVSGMTTDNLKCPCQIPSPEFFTELDGVRLHRFAPPCKPLLREEVSFRVGLHEYPVGSQLPCEPEPDVAVLTSMLTDPSHITAEAAGRRLARGSPPSMASSSASQLSAPSLKATCTANHDSPDAELIEANLLWRQEMGGNITRVESENKVVILDSFDPLVAEEDEREVSVPAEILRKSRRFARALPVWARPDYNPPLVETWKKPDYEPPVVHGCPLPPPRSPPVPPPRKKRTVVLTESTLSTALAELATKSFGSSSTSGITGDNTTTSSEPAPSGCPPDSDVESYSDGSWSTVSSGADTEDVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 151 - protein, 3000 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDIWDWICEVLSDFKTWLKAKLMPQLPGIPFVSCQRGYKGVWRGDGIMHTRCHCGAEITGHVKNGTMRIVGPKTCRNMWSGTFPINAYTTGPCTPLPAPNYTFALWRVSAEEYVEIRQVGDFHYVTGMTTDNLKCPCQVPSPEFFTELDGVRLHRFAPPCKPLLREEVSFRVGLHEYPVGSQLPCEPEPDVAVLTSMLTDPSHITAEAAGRRLARGSPPSMASSSASQLSAPSLRATCTTNHDSPDAELIEANLLWRQEMGGNITRVESENKVVILDSFDPLVAEEDEREVSVPAEILRKSRKFTPALPIWARPDYNPPLVEPWKKPDYEPPVVHGCPLPPPQSPPVPPPRKKRTVILTESTLPTALAELATKSFGSSSTSGITGDDTTTSPEPASSSCPPDSDAESYSDGSWSTVSSEADKEDVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 152 - protein, 2999 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVHGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVSSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWICTVLTDFKTWLQSKLLPRLPGVPFLSCQRGYKGVWRGDGIMQTTCPCGAQIAGHVKNGSMRIVGPRTCSNTWHGTFPINAYTTGPCTPSPAPNYSRALWRVAAEEYVEVTRVGDFHYVTGMTTDNVKCPCQVPAPEFFTEVDGVRLHRYAPACKPLLREDVTFQVGLNQYLVGSQLPCEPEPDVTVLTSMLTDPSHITAETAKRRLARGSPPSLASSSASQLSAPSLKATCTTHHDSPDADLIEANLLWRQEMGGNITRVESENKVVILDSFEPLHAEGDEREISVAAEILRKSRKFPSALPIWARPDYNPPLLESWKDPDYVPPVVHGCPLPPTKAPPIPPPRRKRTVVLTESNVSSALAELATKTFGSSGSSAVDSGTATALPDLASDDGDKGSDVESYSDGSWSTVSEEASEDVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 153 - protein, 3018 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTYDVDMVDANLLMEGGVAQTEPESRVPVLDFLEPMAEEESDLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSAESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 154 - protein, 3018 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFSVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCGGSWLRDVWDWVCTILTDFKNWLTSKLFPKMPGLPFVSCQKGYKGVWAGTGIMTTRCPCGANISGNVRLGSMRITGPKTCMNIWQGTFPINCYTEGQCVPKPAPNFKVAIWRVAASEYAEVTQHGSYHYITGLTTDNLKVPCQLPSPEFFSWVDGVQIHRFAPTPKPFFRDEVSFCVGLNSFVVGSQLPCDPEPDTDVLMSMLTDPSHITAETAARRLARGSPPSEASSSASQLSAPSLRATCTTHGKAYDVDMVDANLFMGGDVTRIESGSKVVVLDSLDPMVEERSDLEPSIPSEYMLPKKRFPPALPAWARPDYNPPLVESWKRPDYQPATVAGCALPPPRKTPTPPPRRRRTVGLSEDSIGDALQQLAIKSFGQPPPSGDSGLSTGAGAADSGSQTPPDELALSETGSIEPEQVEPQPPPQGGVAAPGSDSGSWSTCSEEDDSVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 155 - protein, 3004 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGGWLRDIWDWVCSVLSDFKTWLSAKIMPALPGLPFISCQKGYKGVWRGDGVMSTRCPCGASITGHVKNGSMRLAGPRMCANMWHGTFPINEYTTGPSTPCPSPNYTRALWRVAASSYVEVRRVGDFHYITGATEDELKCPCQVPAAEFFTEVDGVRLHRYAPPCKPLLREEITFSVGLHSYAIGSQLPCEPEPDVSVLTSMLRDPSHITAETAARRLARGSPPSEASSSASQLSAPSLKATCQTHRPHPDAELVDANLLWRQEMGSNITRVESETKVVILDSFEPLRAEADDAELSVAAECFKKPPKYPPALPIWARPDYNPPLLDRWKAPDYVPPTVHGCALPPRGAPPVPPPRRKRTIQLDGSNVSAALAALAEKSFPTPKSQEENSSSSGVDTQSSTTSRMPPSPGGESDSESCSCDSWSTVSDNEEQSVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 156 - protein, 2997 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFSVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKHIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCAESWLWEVWDWVCTVLSDFKTWLKAKLLPLMPGIPFLSCQRGYKGEWRGDGVMHTTCPCGADLAGHIKNGSMRITGPKTCSNTWHGTFPINAYTTGPGVPIPAPNYKFALWRVSAEDYVEVRRVGDFHYVTGVTQDNIKCPCQVPAPEFFTEVDGIRLHRHAPKCKPLLRDEVSFSVGLNSFVVGSQLPCEPEPDVAVLTSMLTDPSHITAESARRRLARGSRPSLASSSASQLSAPSLKATCTAPHDSPGTDLLEANLLWGSTATRVETDEKVIILDSFESCVAEPNDDRGVSVAAEILRPTKKFPPALPIWARPDYNPPLTETWKQQDYKPPTVHGCALPPGKQPPVPPPRRKRTVQLTESVVSTALAELAAKTFGQSEPSSDRDTDLTTPTETTDSGPIVVDDASDDGSYTSDSWSTVSGSEDVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 157 - protein, 3002 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCDGTWLGAIWDWVCTALTDFKAWLQAKLLPQLPGVPFLSCQRGYKGVWRGDGVNSTKCPCGATISGHVKNGTMRIVGPKLCSNTWHGTFPINATTTGPSVPAPAPNYKFALWRVGAADYAEVRRVGDYHYITGVTQDNLKCPCQVPSPEFFTELDGVRIHRYAPPCNPLLREEVCFSVGLHSFVVGSQLPCEPEPDVTVLTSMLSDPAHITAETAKRRLDRGSPPSLASSSASQLSAPSLKATCTTQGHHPDADLIEANLLWRQCMGGNITRVEAENKVVILDSFEPLKADDDDREISVSADCFRRGPAFPPALPVWARPGYDPPLLETWKQPDYDPPQVSGCPLPPAGLPPVPPPRRKRKPVVLSDSNVSQVLADLAHARFKADTQSIEGQDSAVGTSSQPDSGPEEKRDDDSDAASYSSGSWSTVSDEDGVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 158 - protein, 3003 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCATSWLRDVWDWVCTVLSDFRVWLKAKLLPRLPGIPFLSCQTGYRGVWAGDGVCHTTCTCGAVIAGHVKNGTMKITGPKTCSNTWHGTFPINATTTGPSTPRPAPNYQRALWRVSAEDYVEVRRLGDCHYVVGVTAEGLKCPCQVPAPEFFTEVDGVRIHRYAPPCKPLLRDEVTFSVGLSSYAIGSQLPCEPEPDVTVVTSMLTDPTHITAETAARRLKRGSPPSLASSSASQLSAPSLKATCTTSKDHPDMELIEANLLWRQEMGGNITRVESENKVVILDSFEPLTAEYDERENSVSAECHRPPRRKFPPALPIWARPDYNPPLIQAWQMPGYEPPVVSGCAVAPPKPAPIPPPRRKRLVHLDESTVSHALAQLADKVFVESSSDPGPSSDSGLSIASPVPPAPTTPDDACSEAGSYSSGSWSTVSDQDDVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 159 - protein, 2998 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCAGSWLREVWDWVCMVLSDFASWLKAKVLPSLPGIPFLSCQKGYKGEWRNDGIMNTKCPCGALIAGHVKNGSMRIVGPKTCRNTWWGTFPINSHTTGPSSPVPSHCYQRALWRVSATEYVEILRHNDQHYVVGVTAEDLKCPCQVPSPEFFSFVDGVRIHRFAPEPKPMIREEAAFVVGLHSYVVGSQLPCEPEPDVQTVSQLLTDPSHITAETAARRLRRGSPPSNASSSASQLSAPSLKATHTTLPQHPDAELIEANLMWEHKVGAIRRMETDTKVIILDSFDSASSVEDDMEPSTAAECLRTRKVFPPAMPIWARPDYNPPVVENWKDPEYAPPQVSGCALPPAQTPPVPPPRRKRAVIQLTESAVSTALAELAERSFPKEEAPPSDSAISLDSPAANDPPSDCDQGSEISFSDGSWSTVSTRSDVICCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 160 - protein, 3038 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRDDDDKVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTYDVDMVDANLLMEGGVAQTEPESRVPVLDFLEPMAEEESDLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 161 - protein, 3033 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTYDVDMVDANLLMEGGVAQTEPESRVPVLDFLEPMAEDDDDKEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 162 - protein, 3038 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTYDVDMVDANLLMEGGVAQTEPESRVPVLDFLEPMAEEESDLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPLEGEPGDPDLESDQVELQPPPQGGGVAPGSGSDDDDKGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 163 - DNA, 23 bp, Hepatitis C virus
tggcccaaagtggaacaattttg

SEQ ID NO: 164 - DNA, 21 bp, Hepatitis C virus
gacatctgggactggatatgc

SEQ ID NO: 165 - DNA, 21 bp, Hepatitis C virus
gatgtttgggattggatatgc

SEQ ID NO: 166 - DNA, 22 bp, Hepatitis C virus
cctgtcagaagggatacaaggg

SEQ ID NO: 167 - DNA, 25 bp, Hepatitis C virus
aaacctgcagcaacacatggcatgg

SEQ ID NO: 168 - DNA, 21 bp, Hepatitis C virus
caggtaccatctccagagttc

SEQ ID NO: 169 - DNA, 21 bp, Hepatitis C virus
ggacggggtgtgccacaccac

SEQ ID NO: 170 - DNA, 22 bp, Hepatitis C virus
ccaagacctgccgaaacacctg

SEQ ID NO: 171 - DNA, 22 bp, Hepatitis C virus
aggagatgggcggcaacatcac

SEQ ID NO: 172 - DNA, 22 bp, Hepatitis C virus
aggagatgggcggaaacatcac

SEQ ID NO: 173 - DNA, 22 bp, Hepatitis C virus
gtcccctccatcagaggcaagc

SEQ ID NO: 174 - DNA, 25 bp, Hepatitis C virus
gttccctccagcactaccgatctgg

SEQ ID NO: 175 - protein, 21 aa, Hepatitis C virus
GACAGAGAGATCTCTGTGTCC

SEQ ID NO: 176 - DNA, 23 bp, Hepatitis C virus
gctgagtatgacgagagggaaat

SEQ ID NO: 177 - protein, 22 aa, Hepatitis C virus
CATATGGGCGAGGCCAGACTAC

SEQ ID NO: 178 - DNA, 18 bp, Hepatitis C virus
ctggcacgggcatttaag

SEQ ID NO: 179 - DNA, 18 bp, Hepatitis C virus
ctggcatgggcactttac

SEQ ID NO: 180 - DNA, 21 bp, Hepatitis C virus
gctcaagtgtccgtgccaagt

SEQ ID NO: 181 - DNA, 25 bp, Hepatitis C virus
tagcctgatgccgtccacttccgtg

SEQ ID NO: 182 - DNA, 20 bp, Hepatitis C virus
gcggagaccctcgatctagc

SEQ ID NO: 183 - DNA, 22 bp, Hepatitis C virus
ttctctgtgggtctttcaaact

SEQ ID NO: 184 - protein, 20 aa, Hepatitis C virus
GCTGGTCATTGTGACGAAGG

SEQ ID NO: 185 - DNA, 21 bp, Hepatitis C virus
gggcatggaagaataggactc

SEQ ID NO: 186 - DNA, 21 bp, Hepatitis C virus
gggcatggaggagtacgactc

SEQ ID NO: 187 - protein, 23 aa, Hepatitis C virus
GACCGCTGGAAAGCACCGGATTA

SEQ ID NO: 188 - DNA, 23 bp, Hepatitis C virus
ggactcagtgagctgtaccgtcc

SEQ ID NO: 189 - DNA, 20 bp, Hepatitis C virus
gtggtgtgctgctccatgtc

SEQ ID NO: 190 - DNA, 22 bp, Hepatitis C virus
ccgaggcggaagaggctagtgc

SEQ ID NO: 191 - DNA, 18 bp, Hepatitis C virus
ggtctgcgcaggtggtag

SEQ ID NO: 192 - DNA, 24 bp, Hepatitis C virus
ggccattttctcgcagacccggac

SEQ ID NO: 193 - DNA, 9603 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacgaatcctaaacctcaaagaaaaaccaaacgtaacaccaaccgccgcccaatggacgttaagttcccgggtggtggccagatcgttggcggagtttacttgttgccgcgcaggggccccagattgggtgtgcgcgcgactcggaagacttcggagcggtcgcaacctcgtggaagacgccaacctatccccaaggcgcgtcgacccgagggaaggtcctgggcacaaccaggatatccatggcctctttacggtaatgagggttgtgggtgggcaggatggctcttgtccccccgtggctctcgaccgtcttggggcccaaatgatccccggcggaggtcccgcaatttgggtaaggtcatcgataccctaacctgcggcttcgccgacctcatgggatacatcccgctcgtaggcgcccccgtgggtggcgtcgccagggccctggcacatggtgtcagggctttggaggacgggatcaattatgcaacagggaatctccccggttgctccttttctatcttcctcttggcacttctttcgtgcctgactgtccccgcttcggccgttaactatcgcaatgtctcgggcatctaccatgtcaccaatgactgcccgaattcaagcatagtgtatgaggccgaccatcacatcttgcaccttccaggttgcgtgccctgcgtgagagaggggaatcagtcacgctgctgggtggcccttactcctaccgtcgcagcgccatacatcggcgcaccgcttgagtccttacggagtcatgtggatttgatggtgggggccgccactgtttgctcgggtctttacatcggggacctgtgtggcggcttgttcctagttggccagatgttttcattccgaccacggcgccactggaccacccaggattgcaattgttccatctacacagggcacattacaggccacagaatggcctgggacatgatgatgaactggagtccaacaaccaccttagttctcgcccaggtcatgaggatcccaaccactctggtagacttactctctggaggccactggggtgtcctcgtgggagtggcctatttcagcatgcaggccaattgggccaaagtcatcttggtcctattcctctttgcaggggttgatgccgagactcacgtgtctggggcagcagtcggccggagtaccgccggcttggctaacctcttttcttctgggtctaagcagaatttacagctcatcaacagcaatgggagctggcatataaataggactgcccttaactgcaatgacagcttaaacactgggttcttggctagcttgttctacacccacaagtttaacagctcagggtgttccgaacggctcgcgtgctgcaagagccttgacagctacggccaaggctggggcccactcggggtcgctaacatcagcggctcgtctgatgacaggccttattgctggcactacgcgcctcggccgtgcgggattgtgccagcatccagtgtgtgtggccccgtgtattgtttcactcccagccctgtcgtggtcggtactactgatcacgtcggggtccctacttacacctggggggagaatgagactgatgtcttccttttgaactcgaccagaccgccgcatggtgcgtggtttggatgcgtgtggatgaacagtaccgggttcaccaaaacctgtggcgcccctccatgcgaggttaacaccaataatgggacctggcactgccccaccgattgcttcaggaagcatccggagactacctacgccaagtgcggatcagggccttggatcacaccgcgctgcctgattgattacccgtaccggctgtggcatttcccgtgcaccgccaacttctccgtctttaacatcaggacatttgtcggcggtatagagcatcggatgcaagcggcatgcaactggaccaggggggaagtctgtggcttggagcacagggatcgcgtagagctatcacccctgctccttaccactacagcgtggcagatcctcccctgctctttcaccactttacctgccctctccaccggcttgatccacctccaccaaaatatcgtggacgtccagtacctctatggtgttgggtctgcagtggtatcttgggcccttaagtgggaatatgtggtgctcgcgttcctgcttctcgcggacgcgagagtctctgcctgcctatggatgatgtttatggtaagtcaagttgaggcggctctgtccaacctgattaacatcaatgctgcttcagccgctggtgcccaaggcttctggtacgccatcctcttcatctgcattgtctggcatgtcaagggccggttcccagctgctgctgcctacgcagcctgcgggctgtggcccctgtttctcctgcttctgatgctgcctgagagggcttatgcatacgaccaggaagtggcagggtcccttggcggcgccatcgttgtcatgctggccattctgacactgtctccgcactacaagttatggctggctaggggattgtggtggatccaatattttatagctaggaccgaggctgtgctgcatgtctatattccatccttcaacgtgcgcgggcctcgcgactcagtgattgttcttgcagtcctggtctgtccacacctagtatttgacatcacaaaatatcttctggccatcttagggcccctccacatactccaggcctcgctcctacgcatcccttactttgtgagggcacaagcgctggttaagatctgcagcttgttgcgtggggtagtttatggcaagtacttccaaatggtcgtgcttaaagcaggggccctgactggtacttacatctatgaccaccttactcccatgtcagattgggccgctacgggcctccgcgatttggcggtggccctagagccagttgtgttctcgcccatggagaagaaagtcatcgtctggggcgctgacaccgctgcgtgcggagacatcataaggggattacctgtttcggccaggttgggcaatgaaatcttgctcggaccagccgatacagaaacatcaaaggggtggagactccttgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagcacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgcgccgaatcttggctatgggaggtatgggattgggtctgcaccgtgctgagtgacttcaagacgtggctaaaagccaagttgctgcccctcatgccaggcatccccttcctctcatgccagaggggctataagggagagtggcgcggagatggcgtgatgcataccacatgcccctgcggagcagatctggcaggtcacatcaagaacggctcgatgagaatcaccgggccgaaaacctgcagcaacacatggcatggtaccttccccatcaatgcttacaccacaggccctggtgtacccatcccggcgccgaactacaagttcgcgctttggagggtgtccgccgaggactacgtggaggttcgcagagtgggtgatttccattatgtcaccggggtaacacaagacaacatcaagtgcccctgccaagttccggccccagagttcttcacggaagtggacggcatcaggctacaccgccacgccccgaagtgcaaacccttgctgcgggacgaagtgtcgttctcagtaggactcaattcgttcgtagtgggatcacaactcccatgcgagccagagccggacgtggcagtgctaacatccatgctgacagacccatcacacataacggcggaatcggcgcgtcggagattggctcgagggtcacgaccctcgctagctagttcctcggcgagtcagctttccgccccgtctctcaaggccacgtgtaccgctccccatgactcccctggtactgatctcctcgaggctaacctcttgtgggggtctaccgctaccagggttgagacggacgagaaggtaataatactagactcttttgagtcatgtgtggctgagccaaatgatgacaggggagtctcggttgccgcggaaatcctgcgtccgaccaagaagttccctccagcactaccgatctgggcccggccggattacaatccacctcttaccgagacgtggaagcagcaggactacaagcctccgaccgtccacgggtgcgctctgcctcccggcaagcagccccccgttcctcctcccaggaggaaacggacggtacagctcactgagtccgttgtttctaccgctttggcagagctggccgcaaagacctttggccagtcagagccgagctcagaccgtgatacagaccttaccaccccaactgagaccacagactcgggccccatcgtcgtggatgatgcatccgatgacggatcttattcgtcaatgcctccactagagggggagcccggtgacccggacttgacatcagactcttggtccactgttagcggatcggaggacgtcgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 194 - protein, 3008 aa, Hepatitis C virus
MSTNPKPQRKTKRNTNRRPMDVKFPGGGQIVGGVYLLPRRGPRLGVRATRKTSERSQPRGRRQPIPKARRPEGRSWAQPGYPWPLYGNEGCGWAGWLLSPRGSRPSWGPNDPRRRSRNLGKVIDTLTCGFADLMGYIPLVGAPVGGVARALAHGVRALEDGINYATGNLPGCSFSIFLLALLSCLTVPASAVNYRNVSGIYHVTNDCPNSSIVYEADHHILHLPGCVPCVREGNQSRCWVALTPTVAAPYIGAPLESLRSHVDLMVGAATVCSGLYIGDLCGGLFLVGQMFSFRPRRHWTTQDCNCSIYTGHITGHRMAWDMMMNWSPTTTLVLAQVMRIPTTLVDLLSGGHWGVLVGVAYFSMQANWAKVILVLFLFAGVDAETHVSGAAVGRSTAGLANLFSSGSKQNLQLINSNGSWHINRTALNCNDSLNTGFLASLFYTHKFNSSGCSERLACCKSLDSYGQGWGPLGVANISGSSDDRPYCWHYAPRPCGIVPASSVCGPVYCFTPSPVVVGTTDHVGVPTYTWGENETDVFLLNSTRPPHGAWFGCVWMNSTGFTKTCGAPPCEVNTNNGTWHCPTDCFRKHPETTYAKCGSGPWITPRCLIDYPYRLWHFPCTANFSVFNIRTFVGGIEHRMQAACNWTRGEVCGLEHRDRVELSPLLLTTTAWQILPCSFTTLPALSTGLIHLHQNIVDVQYLYGVGSAVVSWALKWEYVVLAFLLLADARVSACLWMMFMVSQVEAALSNLININAASAAGAQGFWYAILFICIVWHVKGRFPAAAAYAACGLWPLFLLLLMLPERAYAYDQEVAGSLGGAIVVMLAILTLSPHYKLWLARGLWWIQYFIARTEAVLHVYIPSFNVRGPRDSVIVLAVLVCPHLVFDITKYLLAILGPLHILQASLLRIPYFVRAQALVKICSLLRGVVYGKYFQMVVLKAGALTGTYIYDHLTPMSDWAATGLRDLAVALEPVVFSPMEKKVIVWGADTAACGDIIRGLPVSARLGNEILLGPADTETSKGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKHIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCAESWLWEVWDWVCTVLSDFKTWLKAKLLPLMPGIPFLSCQRGYKGEWRGDGVMHTTCPCGADLAGHIKNGSMRITGPKTCSNTWHGTFPINAYTTGPGVPIPAPNYKFALWRVSAEDYVEVRRVGDFHYVTGVTQDNIKCPCQVPAPEFFTEVDGIRLHRHAPKCKPLLRDEVSFSVGLNSFVVGSQLPCEPEPDVAVLTSMLTDPSHITAESARRRLARGSRPSLASSSASQLSAPSLKATCTAPHDSPGTDLLEANLLWGSTATRVETDEKVIILDSFESCVAEPNDDRGVSVAAEILRPTKKFPPALPIWARPDYNPPLTETWKQQDYKPPTVHGCALPPGKQPPVPPPRRKRTVQLTESVVSTALAELAAKTFGQSEPSSDRDTDLTTPTETTDSGPIVVDDASDDGSYSSMPPLEGEPGDPDLTSDSWSTVSGSEDVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 195 - DNA, 9624 bp, Artificial
  synthetic
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggttcctggctaagggacatctgggactggatatgcgaggtgctgagcgattttaagacctggctgaaggccaagctcatgccacaactgcctgggattccttttgtgtcctgccaacgcgggtataggggggtctggcgaggggatggcatcatgcacactcgctgccactgtggagctgagatcaccggacatgtcaagaacgggacgatgaggatcgtcggtcctaagacctgcaggaacatgtggagtgggaccttccccatcaacgcctacaccacgggcccctgcaccccccttcctgcgccgaactatacgttcgcgctgtggagggtgtctgcggaggaatacgtggaggtaaggcgggtgggggacttccactacgtgacgggcatgacttctgacaatcttaagtgcccatgtcaggtcccatcgcccgaatttttcacagaattggatggggtgcgcctgcataggttcgcgcccccttgcaagcccttattacgggacgaggtgtcgttcagagttggactacacgaatacctggtggggtcgcaattaccttgcgaacctgaaccagacgtggccgtgttgacgtccatgctcactgatccctcccatataacagcagaggcggctaggaggaggttggcaaggggatcgcccccttctgaggccagctcctcggccagccagctgtccgctccatctctcagggcaacttgcaccaccaaccacgactcccctgacgccgagttaatagaagctaacctcctgtggaggcaggagatgggcagtaacatcaccagggttgagtcggagaacaaagtggtaattctggactccttcgatccgctcgtggcggaggaggatgatcgggaggtctccgtgcccgcagaaatgctgcggaagtctcggagatttgctccggccctgcccatttgggcacggccggactacaaccccccgttgctggagacgtggaaaaagccggactacgaaccacctgtggtccatggctgcccacttccacctccacagtcccctcctgtgcctccgcctcggaagaagcggatggtagtcctcactgaatcaaccttgtccactgccttggccgagcttgccaccaagagctttggcagctcctcaacttccggcatcacgggcgacaatacaacgacgtcctctgagcccgccccctctgtctgccccccggactccgacgctgagtcctgttcttccatgccccccctagagggggagcctggggatccggatctcagcgacgggtcatggtcgacggttagtagtggggccagcccggaggatgtcgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 196 - DNA, 9624 bp, Artificial
  synthetic
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagcgctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggttcctggctaagggacatctgggactggatatgcgaggtgttgagcgactttaagacctggctaaaagctaagctcatgccacagctgcctgggatcccctttgtgtcctgccagcgcgggtataagggggtctggcgagtggacggcatcatgcacactcgctgccactgtggagctgagatcactggacatgtcaaaaacgggacgatgaggatcgtcggtcctaggacctgcaggaacatgtggagtgggaccttccccattaatgcctacaccacgggcccctgtaccccccttcctgcgccgaactacacgttcgcgctatggagggtgtctgcagaggaatatgtggagataaggcaggtgggggacttccactacgtgacgggtatgactactgacaatctcaaatgcccgtgccaggtcccatcgcccgaatttttcacagaattggacggggtgcgcctacataggtttgcgcccccctgcaagcccttgctgcgggaggaggtatcattcagagtaggactccacgaatacccggtagggtcgcaattaccttgcgagcccgaaccggacgtggccgtgttgacgtccatgctcactgatccctcccatataacagcagaggcggccgggcgaaggttggcgaggggatcacccccctctgtggccagctcctcggctagccagctatccgctccatctctcaaggcaacttgcaccgctaaccatgactcccctgatgctgagctcatagaggccaacctcctatggaggcaggagatgggcggcaacatcaccagggttgagtcagaaaacaaagtggtgattctggactccttcgatccgcttgtggcggaggaggacgagcgggagatctccgtacccgcagaaatcctgcggaagtctcggagattcgcccaggccctgcccgtttgggcgcggccggactataaccccccgctagtggagacgtggaaaaagcccgactacgaaccacctgtggtccatggctgtccgcttccacctccaaagtcccctcctgtgcctccgcctcggaagaagcggacggtggtcctcactgaatcaaccctatctactgccttggccgagctcgccaccagaagctttggcagctcctcaacttccggcattacgggcgacaatacgacaacatcctctgagcccgccccttctggctgcccccccgactccgacgctgagtcctattcctccatgccccccctggagggggagcctggggatccggatcttagcgacgggtcatggtcaacggtcagtagtgaggccaacgcggaggatgtcgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 197 - DNA, 9624 bp, Artificial
  synthetic
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagcgctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggctcctggctaagggacatctgggactggatatgcgaggtgctgagcgactttaagacctggctaaaaaccaagctcatgccacatctgcctgggattccctttgtgtcctgccagcacgggtataagggggtctggcggggggacggcattatgcacactcgctgccactgtggagctgagatcactggacatgtcaaaaacggaacgatgaggatcgtcggtcctaagacctgtaggaacatgtggagtgggaccttccccattaacgcctacaccacgggcccctgtactccccttcctgcgccgaactacacgttcgcgctatggagggtgtctgcagaggaatacgtggagataaggcgggtgggggacttccactacgtgacaggcatgactactgataatctcaaatgcccgtgccaggtcccatcgcccgaatttttcacagaattggacggggtgcgcctacataggtttgcgcccccctgcaagcccttgctgcgggaggaggtatcattcagggtaggactccacgattacccggtggggtcgcaattaccttgcgagcccgaaccggacgtggccgtgttgacgtccatgctcactgatccctcccatataacagcagcggcggccgggagaaggttggcgaggggatcacccccttctgaggccagctcctcggctagccagctgtccgctccatctctcaaggcaacttgcaccatcaaccatgactcccctgacgccgagctcatagaagctaacctcctatggaggcaagagatgggcggcaacatcaccagggttgagtcagagaacaaagtggtgattctggactccttcgatccgcttgtggcggaggaggacgagcgggagatctccgtgcccgcagaaatcctgcggaagtctcggagattcacccaggccctgcctatttgggcgcggccggactataaccccccgctgatagagacgtggaaaaagcctaactatgaaccacctgtggtccatggctgtccgcttccacctccacagtcccctcctgtgcctccgcctcggaaaaagcggacggtggtcctcaccgaatcgaccctatccactgccttggccgagcttgccgctaaaagtttcggcagttcctcaacttccggcattacgggcgacaatacgacaacgtcctctgagcccgccccttctggctgttccccagactccgacgctgagtcctattcttccatgccccccctggagggggagcctggggatccggatctcagcgacgggtcatggtcgacggtcagtagtgaggccggcacggaagacgttgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 198 - protein, 3015 aa, Artificial
  synthetic
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDIWDWICEVLSDFKTWLKAKLMPQLPGIPFVSCQRGYRGVWRGDGIMHTRCHCGAEITGHVKNGTMRIVGPKTCRNMWSGTFPINAYTTGPCTPLPAPNYTFALWRVSAEEYVEVRRVGDFHYVTGMTSDNLKCPCQVPSPEFFTELDGVRLHRFAPPCKPLLRDEVSFRVGLHEYLVGSQLPCEPEPDVAVLTSMLTDPSHITAEAARRRLARGSPPSEASSSASQLSAPSLRATCTTNHDSPDAELIEANLLWRQEMGSNITRVESENKVVILDSFDPLVAEEDDREVSVPAEMLRKSRRFAPALPIWARPDYNPPLLETWKKPDYEPPVVHGCPLPPPQSPPVPPPRKKRMVVLTESTLSTALAELATKSFGSSSTSGITGDNTTTSSEPAPSVCPPDSDAESCSSMPPLEGEPGDPDLSDGSWSTVSSGASPEDVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 199 - protein, 3015 aa, Artificial
  synthetic
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDIWDWICEVLSDFKTWLKAKLMPQLPGIPFVSCQRGYKGVWRVDGIMHTRCHCGAEITGHVKNGTMRIVGPRTCRNMWSGTFPINAYTTGPCTPLPAPNYTFALWRVSAEEYVEIRQVGDFHYVTGMTTDNLKCPCQVPSPEFFTELDGVRLHRFAPPCKPLLREEVSFRVGLHEYPVGSQLPCEPEPDVAVLTSMLTDPSHITAEAAGRRLARGSPPSVASSSASQLSAPSLKATCTANHDSPDAELIEANLLWRQEMGGNITRVESENKVVILDSFDPLVAEEDEREISVPAEILRKSRRFAQALPVWARPDYNPPLVETWKKPDYEPPVVHGCPLPPPKSPPVPPPRKKRTVVLTESTLSTALAELATRSFGSSSTSGITGDNTTTSSEPAPSGCPPDSDAESYSSMPPLEGEPGDPDLSDGSWSTVSSEANAEDVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 200 - protein, 3015 aa, Artificial
  synthetic
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLSRFLWWLCYLLTLGEAMVQEWAPPMQVRGGRDGIIWAVAIFYPGVVFDITKWLLAVLGPAYLLKGALTRVPYFVRAHALLRMCTMARHLAGGRYVQMALLALGRWTGTYIYDHLTPMSDWAASGLRDLAVAVEPIIFSPMEKKVIVWGAETAACGDILHGLPVSARLGREVLLGPADGYTSKGWSLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDIWDWICEVLSDFKTWLKTKLMPHLPGIPFVSCQHGYKGVWRGDGIMHTRCHCGAEITGHVKNGTMRIVGPKTCRNMWSGTFPINAYTTGPCTPLPAPNYTFALWRVSAEEYVEIRRVGDFHYVTGMTTDNLKCPCQVPSPEFFTELDGVRLHRFAPPCKPLLREEVSFRVGLHDYPVGSQLPCEPEPDVAVLTSMLTDPSHITAAAAGRRLARGSPPSEASSSASQLSAPSLKATCTINHDSPDAELIEANLLWRQEMGGNITRVESENKVVILDSFDPLVAEEDEREISVPAEILRKSRRFTQALPIWARPDYNPPLIETWKKPNYEPPVVHGCPLPPPQSPPVPPPRKKRTVVLTESTLSTALAELAAKSFGSSSTSGITGDNTTTSSEPAPSGCSPDSDAESYSSMPPLEGEPGDPDLSDGSWSTVSSEAGTEDVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

What is claimed are:

1. A RNA comprising structural genes (Core, E1 and E2), p7 and non-structural gene NS2 from a human hepatitis C virus selected from the group consisting of genotypes 1a, 1b, 2a, 3a, 4a, 5a, 6a and 7a, non-structural genes NS3, NS4A, NS4B and NS5B from the human hepatitis C virus genotype 2a strain JFH1, an HCV 5' UTR and an HCV 3' UTR, and non-structural gene NS5A from the human hepatitis C virus genotype selected from the group consisting of 1a, 1b, 2a, 3a, 4a, 5a, 6a and 7a with the proviso that the NS5A gene from a genotype 2a strain is not JFH1, wherein the genotype of Core-NS2 correspond to that selected of the NS5A genotype, wherein the RNA is capable of infection in vitro, and wherein the corresponding cDNA sequence of said RNA comprises a sequence selected from the group consisting of SEQ ID NO:44, SEQ ID NO:46, SEQ ID NO:47, SEQ ID NO:49, SEQ ID NO:52, SEQ ID NO:54, SEQ ID NO:56, and SEQ ID NO:58 except for one or more adaptive mutations encoding amino acid substitutions selected from the group consisting of C1185S, Y1644H, E2264G, I2274N, C2422R, and C2439R.

2. The RNA of claim 1, wherein said HCV 5' UTR and said HCV 3' UTR are from the human hepatitis C virus genotype 2a strain JFH1.

3. The RNA of claim 1, wherein said corresponding cDNA sequence further comprises one or more additional adaptive mutations that are nucleotide substitutions selected from the group consisting of T3893A, T5270C, A6275G, A7131 G, T7161A, T7604C, and T7625C.

4. A RNA comprising the structural genes (Core, E1 and E2), p7 and the non-structural gene NS2 from the human hepatitis C virus genotype 2a strain J6, the non-structural genes NS3, NS4A, NS4B and NS5B from the human hepatitis C virus genotype 2a strain JFH1, an HCV 5' UTR and an HCV 3' UTR, and the non-structural gene NS5A from the human hepatitis C virus genotype selected from the group consisting of 1a, 1b, 2a, 3a, 4a, 5a, 6a and 7a with the proviso that the NS5A gene from genotype 2a strain is not JFH1, wherein the corresponding cDNA sequence of said RNA comprises a sequence selected from the group consisting of SEQ ID NO:1, SEQ ID NO:3, SEQ ID NO:5, SEQ ID NO:11, SEQ ID NO:13, SEQ ID NO:24, SEQ ID NO:33, SEQ ID NO:40 and SEQ ID NO:43 except for one or more adaptive mutations encoding amino acid substitutions selected from the group consisting of R785G, R871H, G1045S, C1189S, T1508P, Y1648H, D1979G, R1982G, E2268G, I2272N, W2414R, E2416G, and S2422G, and wherein the RNA is capable of infection in vitro.

5. The RNA of claim 4, wherein said HCV 5' UTR and said HCV 3' UTR are from the human hepatitis C virus genotype 2a strain JFH1.

6. The RNA of claim 4, wherein said adaptive mutations selected from the group consisting of R785G, R871H, G1045S, C1189S, T1508P, Y1648H, D1979G, R1982G, E2268G, I2272N, W2414R, E2416G, and S2422G are respectively encoded by nucleotide substitutions selected from the group consisting of C2693G, G2952A, G3473A, T3905A, A4862C, T5258C, A6276G, A6284G, A7143G, T7155A, T7580C, A7587G and A7604G.

7. An isolated cell comprising the RNA of claim 1.

8. The cell of claim 7, wherein said cell is an Huh-7.5 cell.

9. A viral particle comprising the RNA of claim 1.

10. A method for producing a hepatitis C virus particle, comprising culturing the cell according to claim 7.

11. The RNA of claim 1, wherein the corresponding cDNA sequence is SEQ ID NO:49 or SEQ ID NO:52.

12. The RNA of claim 11, wherein the corresponding cDNA sequence comprises SEQ ID NO:49 except for one or more adaptive mutations encoding amino acid substitutions selected from the group consisting of C1185S, Y1644H, E2264G, I2274N, C2422R, and C2439R and wherein the corresponding cDNA sequence further comprises an additional adaptive mutation that is a nucleotide substitution T7625C.

13. The RNA of claim 11, wherein the corresponding cDNA sequence comprises SEQ ID NO:52 except for one or more adaptive mutations encoding amino acid substitutions selected from the group consisting of C1185S, Y1644H, E2264G, I2274N, C2422R, and C2439R and wherein the corresponding cDNA sequence further comprises one or more additional adaptive mutation(s) selected from the group consisting of T1404C, A3332G, T5270C, T6291C, A7131G, A7149G, G7547C, and A8019G.

14. The RNA of claim 11, wherein the corresponding cDNA sequence comprises SEQ ID NO:52 except for one or more adaptive mutations encoding amino acid substitutions selected from the group consisting of C1185S, Y1644H, E2264G, I2274N, C2422R, and C2439R and wherein the corresponding cDNA sequence further comprises additional adaptive mutation(s) selected from the group consisting of T5270C, A7131G, and the combination thereof.

15. The RNA of claim 4, wherein the corresponding cDNA sequence comprises SEQ ID NO: 13 or SEQ ID NO: 24 except for one or more adaptive mutations encoding amino acid substitutions selected from the group consisting of R785G, R871H, G1045S, C1189S, T1508P, Y1648H, D1979G, R1982G, E2268G, I2272N, W2414R, E2416G, and S2422G.

16. The RNA of claim 4, wherein the corresponding cDNA sequence comprises SEQ ID NO: 13 except for one or more adaptive mutations encoding amino acid substitutions selected from the group consisting of R785G, G1045S, T1508P, D1979G, and W2414R, and wherein the adaptive mutation(s) are respectively encoded by nucleotide substitutions C2693G, G3473A, A4862C, A6276G, and T7580C.

17. The RNA of claim 4, wherein the corresponding cDNA sequence comprises SEQ ID NO: 13 except for one or more adaptive mutations encoding amino acid substitutions selected from the group consisting of R785G, T1508P, D1979G, W2414R, and wherein the adaptive mutation(s) are respectively encoded by nucleotide substitutions C2693G, A4862C, A6276G, and T7580C.

18. The RNA of claim 4, wherein the corresponding cDNA sequence comprises SEQ ID NO:24 except for one or more adaptive mutations encoding amino acid substitutions selected from the group consisting of Y1648H, E2268G and E2416G, and wherein the adaptive mutation(s) are respectively encoded by nucleotide substitutions T5282C, A7143G, and A7587G.

* * * * *